United States Patent
Butler et al.

(10) Patent No.: US 9,982,257 B2
(45) Date of Patent: May 29, 2018

(54) CHIRAL CONTROL

(71) Applicant: WAVE LIFE SCIENCES LTD., Singapore (SG)

(72) Inventors: David Butler, Medford, MA (US); Naoki Iwamoto, Brighton, MA (US); Meena, Belmont, MA (US); Nenad Svrzikapa, Cambridge, MA (US); Gregory L. Verdine, Boston, MA (US); Ivan Zlatev, Cambridge, MA (US)

(73) Assignee: WAVE LIFE SCIENCES LTD., Singapore (SG)

( * ) Notice: Subject to any disclaimer, the term of this patent is extended or adjusted under 35 U.S.C. 154(b) by 0 days. days.

(21) Appl. No.: 14/414,614

(22) PCT Filed: Jul. 12, 2013

(86) PCT No.: PCT/US2013/050407
§ 371 (c)(1),
(2) Date: Jan. 13, 2015

(87) PCT Pub. No.: WO2014/012081
PCT Pub. Date: Jan. 16, 2014

(65) Prior Publication Data
US 2015/0211006 A1    Jul. 30, 2015

Related U.S. Application Data

(60) Provisional application No. 61/671,655, filed on Jul. 13, 2012, provisional application No. 61/671,656, filed on Jul. 13, 2012, provisional application No. 61/671,724, filed on Jul. 14, 2012, provisional application No. 61/671,722, filed on Jul. 14, 2012.

(51) Int. Cl.
| | |
|---|---|
| *C12N 15/113* | (2010.01) |
| *C07C 317/28* | (2006.01) |
| *C07D 295/088* | (2006.01) |
| *C07H 21/00* | (2006.01) |
| *C12N 15/11* | (2006.01) |
| *C12Q 1/68* | (2018.01) |

(52) U.S. Cl.
CPC .......... *C12N 15/113* (2013.01); *C07C 317/28* (2013.01); *C07D 295/088* (2013.01); *C07H 21/00* (2013.01); *C12N 15/11* (2013.01); *C12Q 1/6876* (2013.01); *C12N 15/111* (2013.01); *C12N 2310/11* (2013.01); *C12N 2310/14* (2013.01); *C12N 2310/31* (2013.01); *C12N 2310/315* (2013.01); *C12N 2330/30* (2013.01)

(58) Field of Classification Search
CPC .................................................. C07H 21/04
See application file for complete search history.

(56) References Cited

U.S. PATENT DOCUMENTS

| | | |
|---|---|---|
| 2,878,264 A | 3/1959 | Lunsford |
| 3,135,766 A | 6/1964 | Gould |
| 3,484,473 A | 12/1969 | Buckman et al. |
| 3,687,808 A | 8/1972 | Merigan et al. |
| 3,745,162 A | 7/1973 | Helsley |
| 4,022,791 A | 5/1977 | Welch, Jr. |
| 4,113,869 A | 9/1978 | Gardner |
| 4,415,732 A | 11/1983 | Caruthers et al. |
| 4,458,066 A | 7/1984 | Caruthers et al. |
| 4,500,707 A | 2/1985 | Caruthers et al. |
| 4,542,142 A | 9/1985 | Martel et al. |
| 4,659,774 A | 4/1987 | Webb et al. |
| 4,663,328 A | 5/1987 | Lafon |
| 4,668,777 A | 5/1987 | Caruthers et al. |
| 4,725,677 A | 2/1988 | Koster et al. |
| 4,735,949 A | 4/1988 | Domagala et al. |
| 4,840,956 A | 6/1989 | Domagala et al. |
| 4,845,205 A | 7/1989 | Huynh Dinh et al. |
| 4,923,901 A | 5/1990 | Koester et al. |
| 4,973,679 A | 11/1990 | Caruthers et al. |

(Continued)

FOREIGN PATENT DOCUMENTS

| | | |
|---|---|---|
| CN | 1345328 A | 4/2002 |
| CN | 102675386 A | 9/2012 |

(Continued)

OTHER PUBLICATIONS

Amarzguioui et al., Tolerance for mutations and chemical modifications in a siRNA, Nucleic Acids Research 31(2): 589-595 (2003).

Arai, K. et al., Synthesis and properties of novel 2'-O-alkoxymethyl-modified nucleic acids, Bioorganic & Medicinal Chemistry Letters, 21(21): 6285-6287 (2011).

Bobkov, G.V. et al., Phosphoramidite building blocks for efficient incorporation of 2'-O-aminoethoxy(and propoxy)methyl nucleosides into oligonucleotides, Tetrahedron, 64: 6238-6251 (2008).

Braasch et al., RNA Interference in Mammalian Cells by Chemically-Modified RNA, Biochemistry 42(26): 7967-7975 (2003).

Burgers et al., Absolute configuration of the diastereomers of adenosine 5' -O-(1-thiotriphosphate): Consequences for the stereochemistry of polymerization by DNA-dependent RNA polymerase from *Escherichia coli*, Proceedings of the National Academy of Sciences of the United States of America 75(10): 4798-4800 (1978).

CAS RN 78-96-6, Entered STN: Nov. 16, 1984.

Clark, J.H, Flouride IOn as a Base in Organic Synthesis, Chemical Reviews, 1980 American.

(Continued)

Primary Examiner — Kimberly Chong
(74) Attorney, Agent, or Firm — Choate, Hall & Stewart LLP; Brenda Herschbach Jarrell; Xiaodong Li

(57) ABSTRACT

The present invention relates to chirally controlled oligonucleotides, chirally controlled oligonucleotide compositions, and the method of making and using the same. The invention specifically encompasses the identification of the source of certain problems with prior methodologies for preparing chiral oligonucleotides, including problems that prohibit preparation of fully chirally controlled compositions, particularly compositions comprising a plurality of oligonucleotide types. In some embodiments, the present invention provides chirally controlled oligonucleotide compositions. In some embodiments, the present invention provides methods of making chirally controlled oligonucleotides and chirally controlled oligonucleotide compositions.

48 Claims, 82 Drawing Sheets

(56) References Cited

U.S. PATENT DOCUMENTS

| | | |
|---|---|---|
| 4,981,957 A | 1/1991 | Lebleu et al. |
| 5,047,524 A | 9/1991 | Andrus et al. |
| 5,118,800 A | 6/1992 | Smith et al. |
| 5,130,302 A | 7/1992 | Spielvogel et al. |
| 5,132,418 A | 7/1992 | Caruthers et al. |
| 5,134,066 A | 7/1992 | Rogers et al. |
| 5,141,813 A | 8/1992 | Nelson |
| 5,151,510 A | 9/1992 | Stec et al. |
| 5,175,273 A | 12/1992 | Bischofberger et al. |
| 5,200,553 A | 4/1993 | Nudelman et al. |
| 5,212,295 A | 5/1993 | Cook |
| 5,262,530 A | 11/1993 | Andrus et al. |
| 5,292,875 A | 3/1994 | Stec et al. |
| 5,319,080 A | 6/1994 | Leumann |
| 5,359,044 A | 10/1994 | Cook et al. |
| 5,367,066 A | 11/1994 | Urdea et al. |
| 5,432,272 A | 7/1995 | Benner |
| 5,457,187 A | 10/1995 | Gmeiner et al. |
| 5,457,191 A | 10/1995 | Cook et al. |
| 5,459,255 A | 10/1995 | Cook et al. |
| 5,484,908 A | 1/1996 | Froehler et al. |
| 5,502,177 A | 3/1996 | Matteucci et al. |
| 5,506,212 A | 4/1996 | Hoke et al. |
| 5,512,668 A | 4/1996 | Stec et al. |
| 5,521,302 A | 5/1996 | Cook |
| 5,525,711 A | 6/1996 | Hawkins et al. |
| 5,552,540 A | 9/1996 | Haralambidis |
| 5,576,302 A | 11/1996 | Cook et al. |
| 5,587,361 A | 12/1996 | Cook et al. |
| 5,587,469 A | 12/1996 | Cook et al. |
| 5,594,121 A | 1/1997 | Froehler et al. |
| 5,596,091 A | 1/1997 | Switzer |
| 5,599,797 A | 2/1997 | Cook et al. |
| 5,607,923 A | 3/1997 | Cook et al. |
| 5,614,617 A | 3/1997 | Cook et al. |
| 5,620,963 A | 4/1997 | Cook et al. |
| 5,635,488 A | 6/1997 | Cook et al. |
| 5,643,889 A | 7/1997 | Suhadolnik et al. |
| 5,643,989 A | 7/1997 | Van De Grampel et al. |
| 5,646,267 A | 7/1997 | Stec et al. |
| 5,654,284 A | 8/1997 | Cook et al. |
| 5,661,134 A | 8/1997 | Cook et al. |
| 5,681,940 A | 10/1997 | Wang et al. |
| 5,681,941 A | 10/1997 | Cook et al. |
| 5,708,161 A | 1/1998 | Reese |
| 5,712,378 A | 1/1998 | Wang |
| 5,734,041 A | 3/1998 | Just et al. |
| 5,750,692 A | 5/1998 | Cook et al. |
| 5,795,765 A | 8/1998 | Izu et al. |
| 5,824,503 A | 10/1998 | Kurome et al. |
| 5,846,466 A | 12/1998 | Abe et al. |
| 5,851,840 A | 12/1998 | Sluka et al. |
| 5,852,188 A | 12/1998 | Cook |
| 5,856,465 A | 1/1999 | Stec et al. |
| 5,883,237 A | 3/1999 | Stec et al. |
| 5,898,031 A | 4/1999 | Crooke |
| 5,908,772 A | 6/1999 | Mitta et al. |
| 5,914,396 A | 6/1999 | Cook et al. |
| 5,932,450 A | 8/1999 | Dattagupta et al. |
| 5,936,080 A | 8/1999 | Stec et al. |
| 5,976,855 A | 11/1999 | Svendsen et al. |
| 5,998,602 A | 12/1999 | Torrence et al. |
| 6,004,813 A | 12/1999 | Serlupi-Crescenzi et al. |
| 6,015,886 A | 1/2000 | Dale et al. |
| 6,015,887 A | 1/2000 | Teng |
| 6,017,700 A * | 1/2000 | Horn ............ C07H 21/00 435/6.14 |
| 6,031,092 A | 2/2000 | Just et al. |
| 6,056,973 A | 5/2000 | Allen et al. |
| 6,057,371 A | 5/2000 | Glennon |
| 6,066,500 A | 5/2000 | Bennett et al. |
| 6,080,543 A | 6/2000 | Engel et al. |
| 6,107,094 A | 8/2000 | Crooke |
| 6,124,445 A | 9/2000 | Imbach et al. |
| 6,133,438 A | 10/2000 | Cook et al. |
| 6,140,096 A | 10/2000 | Kofod et al. |
| 6,146,829 A | 11/2000 | Cook et al. |
| 6,147,200 A | 11/2000 | Manoharan et al. |
| 6,159,728 A | 12/2000 | Stockley et al. |
| 6,160,109 A | 12/2000 | Just et al. |
| 6,166,197 A | 12/2000 | Cook et al. |
| 6,172,209 B1 | 1/2001 | Manoharan et al. |
| 6,191,266 B1 | 2/2001 | Wang |
| 6,207,646 B1 | 3/2001 | Krieg et al. |
| 6,214,805 B1 | 4/2001 | Torrence et al. |
| 6,222,025 B1 | 4/2001 | Cook et al. |
| 6,235,887 B1 | 5/2001 | Froehler et al. |
| 6,239,116 B1 | 5/2001 | Krieg et al. |
| 6,239,265 B1 | 5/2001 | Cook |
| 6,242,589 B1 | 6/2001 | Cook et al. |
| 6,248,519 B1 | 6/2001 | Engel et al. |
| 6,265,172 B1 | 7/2001 | St Clair et al. |
| 6,270,968 B1 | 8/2001 | Dalbøge et al. |
| 6,271,004 B1 | 8/2001 | Warthoe |
| 6,300,069 B1 | 10/2001 | Missel et al. |
| 6,306,627 B1 | 10/2001 | Decker |
| 6,316,024 B1 | 11/2001 | Allen et al. |
| 6,316,626 B1 | 11/2001 | Swayze et al. |
| 6,322,985 B1 | 11/2001 | Kashi et al. |
| 6,326,199 B1 | 12/2001 | Cook et al. |
| 6,339,066 B1 | 1/2002 | Bennett et al. |
| 6,344,356 B1 | 2/2002 | Stemmer |
| 6,369,209 B1 | 4/2002 | Manoharan et al. |
| 6,369,237 B1 | 4/2002 | Verdine et al. |
| 6,380,368 B1 | 4/2002 | Froehler et al. |
| 6,383,808 B1 | 5/2002 | Monia et al. |
| 6,407,223 B1 | 6/2002 | Stec et al. |
| 6,440,739 B1 | 8/2002 | Bennett et al. |
| 6,440,943 B1 | 8/2002 | Cook et al. |
| 6,451,524 B1 | 9/2002 | Ecker |
| 6,455,308 B1 | 9/2002 | Freier |
| 6,468,983 B2 | 10/2002 | Silverman et al. |
| 6,500,945 B2 | 12/2002 | Cook |
| 6,506,594 B1 | 1/2003 | Barany et al. |
| 6,506,894 B1 | 1/2003 | Reese et al. |
| 6,528,262 B1 | 3/2003 | Gilad et al. |
| 6,528,640 B1 | 3/2003 | Beigelman et al. |
| 6,538,126 B1 | 3/2003 | Cho et al. |
| 6,559,279 B1 | 5/2003 | Manoharan et al. |
| 6,562,960 B1 | 5/2003 | Baxter et al. |
| 6,582,936 B1 | 6/2003 | Serafini et al. |
| 6,608,186 B1 | 8/2003 | Miculka et al. |
| 6,610,837 B1 | 8/2003 | Guzaev et al. |
| 6,613,873 B1 | 9/2003 | Buchardt et al. |
| 6,617,438 B1 | 9/2003 | Beigelman et al. |
| 6,632,600 B1 | 10/2003 | Short |
| 6,639,022 B2 | 10/2003 | Michels et al. |
| 6,639,062 B2 | 10/2003 | Manoharan et al. |
| 6,649,750 B1 | 11/2003 | Capaldi et al. |
| 6,682,889 B1 | 1/2004 | Wang et al. |
| 6,699,979 B2 | 3/2004 | Cook |
| 6,737,520 B2 | 5/2004 | Manoharan et al. |
| 6,762,281 B2 | 7/2004 | Manoharan et al. |
| 6,767,739 B2 | 7/2004 | Crooke et al. |
| 6,809,195 B1 | 10/2004 | Sanghvi et al. |
| 6,811,975 B2 | 11/2004 | Cook et al. |
| 6,861,518 B2 | 3/2005 | Just et al. |
| 6,867,294 B1 | 3/2005 | Sanghvi et al. |
| 6,933,146 B2 | 8/2005 | Helliwell et al. |
| 6,933,288 B2 | 8/2005 | Migawa et al. |
| 6,936,432 B2 | 8/2005 | Gopalan et al. |
| 6,949,520 B1 | 9/2005 | Hartmann et al. |
| 6,977,245 B2 | 12/2005 | Klinman et al. |
| 6,995,259 B1 | 2/2006 | Vargeese et al. |
| 7,015,315 B1 | 3/2006 | Cook et al. |
| 7,018,793 B1 | 3/2006 | Short |
| 7,019,127 B2 | 3/2006 | Reese et al. |
| 7,022,833 B2 | 4/2006 | Reese |
| 7,030,230 B2 | 4/2006 | Ross et al. |
| 7,045,610 B2 | 5/2006 | Dempcy et al. |
| 7,049,122 B2 | 5/2006 | Chang et al. |
| 7,067,497 B2 | 6/2006 | Hanecak et al. |
| 7,101,993 B1 | 9/2006 | Cook et al. |
| 7,119,184 B2 | 10/2006 | Manoharan et al. |

(56) References Cited

U.S. PATENT DOCUMENTS

| | | | |
|---|---|---|---|
| RE39,464 E | 1/2007 | Cook et al. |
| 7,160,920 B2 | 1/2007 | Garvey et al. |
| 7,205,399 B1 | 4/2007 | Vargeese et al. |
| 7,214,491 B2 | 5/2007 | Yadav et al. |
| 7,227,014 B2 | 6/2007 | Crooke et al. |
| 7,259,150 B2 | 8/2007 | Crooke et al. |
| 7,264,932 B2 | 9/2007 | Latham et al. |
| 7,271,156 B2 | 9/2007 | Krieg et al. |
| 7,288,376 B2 | 10/2007 | Sarma et al. |
| 7,303,895 B1 | 12/2007 | O'Regan et al. |
| 7,304,081 B2 | 12/2007 | Yao et al. |
| 7,354,909 B2 | 4/2008 | Klinman et al. |
| 7,381,527 B2 | 6/2008 | Sarma et al. |
| 7,399,845 B2 | 7/2008 | Seth et al. |
| 7,407,943 B2 | 8/2008 | Crooke et al. |
| 7,410,975 B2 | 8/2008 | Lipford et al. |
| 7,414,116 B2 | 8/2008 | Milton et al. |
| 7,425,545 B2 | 9/2008 | Crooke et al. |
| 7,427,672 B2 | 9/2008 | Imanishi et al. |
| 7,432,249 B2 | 10/2008 | Crooke |
| 7,432,250 B2 | 10/2008 | Crooke |
| 7,495,088 B1 | 2/2009 | Brakel et al. |
| 7,501,091 B2 | 3/2009 | Munoz et al. |
| 7,507,808 B2 | 3/2009 | Dobie |
| 7,507,811 B2 | 3/2009 | Khvorova et al. |
| 7,511,131 B2 | 3/2009 | Crooke et al. |
| 7,517,520 B2 | 4/2009 | Manolova et al. |
| 7,534,879 B2 | 5/2009 | van Deutekom |
| 7,537,767 B2 | 5/2009 | Bachmann et al. |
| 7,547,684 B2 | 6/2009 | Seth et al. |
| 7,585,847 B2 | 9/2009 | Bratzler et al. |
| 7,598,031 B2 | 10/2009 | Liew |
| 7,598,227 B2 | 10/2009 | Crooke et al. |
| 7,629,321 B2 | 12/2009 | Crooke |
| 7,662,558 B2 | 2/2010 | Liew |
| 7,666,854 B2 | 2/2010 | Seth et al. |
| 7,666,888 B2 | 2/2010 | Bartberger et al. |
| 7,683,036 B2 | 3/2010 | Esau et al. |
| 7,695,902 B2 | 4/2010 | Crooke |
| 7,696,345 B2 | 4/2010 | Allerson et al. |
| 7,718,623 B2 | 5/2010 | Kitagawa et al. |
| 7,723,508 B2 | 5/2010 | Crooke et al. |
| 7,732,590 B2 | 6/2010 | Bhanot et al. |
| 7,732,660 B2 | 6/2010 | Helliwell et al. |
| 7,741,305 B2 | 6/2010 | Crooke et al. |
| 7,749,700 B2 | 7/2010 | Baird et al. |
| 7,750,131 B2 | 7/2010 | Seth et al. |
| 7,750,141 B2 | 7/2010 | Crooke et al. |
| 7,750,731 B2 | 7/2010 | Poulsen et al. |
| 7,759,318 B1 | 7/2010 | Perera et al. |
| 7,776,344 B2 | 8/2010 | Hartmann et al. |
| 7,776,874 B2 | 8/2010 | Yao et al. |
| 7,777,023 B2 | 8/2010 | Vargeese et al. |
| 7,803,930 B2 | 9/2010 | Crooke et al. |
| 7,807,816 B2 | 10/2010 | Wilton et al. |
| 7,812,003 B2 | 10/2010 | Safe et al. |
| 7,838,287 B2 | 11/2010 | Goldsmith et al. |
| 7,863,252 B2 | 1/2011 | Crooke et al. |
| 7,884,086 B2 | 2/2011 | Bennett et al. |
| 7,884,117 B2 | 2/2011 | Zhang et al. |
| 7,888,324 B2 | 2/2011 | Crooke et al. |
| 7,893,039 B2 | 2/2011 | Swayze et al. |
| 7,919,472 B2 | 4/2011 | Monia et al. |
| 7,947,658 B2 | 5/2011 | Aronin et al. |
| 7,951,934 B2 | 5/2011 | Freier |
| 7,960,541 B2 | 6/2011 | Wilton et al. |
| 7,973,015 B2 | 7/2011 | van Ommen et al. |
| 8,003,619 B2 | 8/2011 | Hartmann et al. |
| 8,008,011 B2 | 8/2011 | Schmutz et al. |
| 8,008,459 B2 | 8/2011 | Goldsmith et al. |
| 8,039,235 B2 | 10/2011 | Lin et al. |
| 8,058,288 B2 | 11/2011 | Yao et al. |
| 8,067,173 B2 | 11/2011 | Liew |
| 8,076,303 B2 | 12/2011 | Iyer et al. |
| 8,084,437 B2 | 12/2011 | Freier et al. |
| 8,084,600 B2 | 12/2011 | Natt et al. |
| 8,088,582 B2 | 1/2012 | Sampath et al. |
| 8,093,222 B2 | 1/2012 | Freier et al. |
| 8,093,225 B2 | 1/2012 | Mamet |
| 8,101,348 B2 | 1/2012 | Tuschl et al. |
| 8,101,358 B2 | 1/2012 | Liew |
| 8,101,585 B2 | 1/2012 | Yu et al. |
| 8,101,743 B2 | 1/2012 | Brown-Driver et al. |
| 8,106,025 B2 | 1/2012 | Bennett et al. |
| 8,110,358 B2 | 2/2012 | Liew |
| 8,110,558 B2 | 2/2012 | Bennett et al. |
| 8,114,597 B2 | 2/2012 | Liew |
| 8,124,745 B2 | 2/2012 | Allerson et al. |
| 8,133,674 B2 | 3/2012 | Liew |
| 8,133,675 B2 | 3/2012 | Liew |
| 8,133,876 B2 | 3/2012 | Bennett et al. |
| 8,138,328 B2 | 3/2012 | Crooke et al. |
| 8,143,230 B2 | 3/2012 | Bhanot et al. |
| 8,148,072 B2 | 4/2012 | Liew |
| 8,158,598 B2 | 4/2012 | Bhanot et al. |
| 8,178,506 B2 | 5/2012 | Lollo et al. |
| 8,188,059 B2 | 5/2012 | Bhanot et al. |
| 8,206,923 B2 | 6/2012 | Garza Gonzalez et al. |
| 8,207,263 B2 | 6/2012 | Popot et al. |
| 8,232,384 B2 | 7/2012 | Wilton et al. |
| 8,257,922 B2 | 9/2012 | Liew |
| 8,258,289 B2 | 9/2012 | Bhanot et al. |
| 8,361,977 B2 | 1/2013 | Baker et al. |
| 8,383,660 B2 | 2/2013 | Chang et al. |
| 8,415,465 B2 | 4/2013 | Freier |
| 8,431,693 B2 | 4/2013 | Manoharan et al. |
| 8,450,474 B2 | 5/2013 | Wilton et al. |
| 8,455,634 B2 | 6/2013 | Wilton et al. |
| 8,455,635 B2 | 6/2013 | Wilton et al. |
| 8,455,636 B2 | 6/2013 | Wilton et al. |
| 8,470,987 B2 | 6/2013 | Wada et al. |
| 8,476,423 B2 | 7/2013 | Wilton et al. |
| 8,481,710 B2 | 7/2013 | Davidson et al. |
| 8,486,907 B2 | 7/2013 | Wilton et al. |
| 8,501,414 B2 | 8/2013 | Danzer et al. |
| 8,524,880 B2 | 9/2013 | Wilton et al. |
| 8,557,549 B2 | 10/2013 | Chang et al. |
| 8,592,566 B2 | 11/2013 | Iwamura et al. |
| 8,632,963 B2 | 1/2014 | Shah et al. |
| 8,633,206 B2 | 1/2014 | Promo et al. |
| 8,647,742 B2 | 2/2014 | Dendukuri et al. |
| 8,648,186 B2 | 2/2014 | Monteleone |
| 8,669,058 B2 | 3/2014 | Liew |
| 8,674,044 B2 | 3/2014 | Popot et al. |
| 8,679,750 B2 | 3/2014 | Hayden et al. |
| 8,680,063 B2 | 3/2014 | Aronin et al. |
| 8,729,036 B2 | 5/2014 | Zamore et al. |
| 8,735,417 B2 | 5/2014 | Altman et al. |
| 8,750,507 B2 | 6/2014 | Roosta et al. |
| 8,754,107 B2 | 6/2014 | George et al. |
| 8,759,507 B2 | 6/2014 | Van Deutekom |
| 8,809,516 B2 | 8/2014 | Manoharan et al. |
| 8,822,671 B2 | 9/2014 | Shimizu et al. |
| 8,859,755 B2 | 10/2014 | Wada et al. |
| 8,877,435 B2 | 11/2014 | Helliwell et al. |
| 8,883,969 B2 | 11/2014 | Ide et al. |
| 8,952,145 B2 | 2/2015 | Freier |
| 8,957,040 B2 | 2/2015 | Bennett et al. |
| 8,957,042 B2 | 2/2015 | Safe et al. |
| 8,975,389 B2 | 3/2015 | Manoharan et al. |
| 8,980,853 B2 | 3/2015 | Bennett et al. |
| 8,987,222 B2 | 3/2015 | Aronin et al. |
| 8,993,738 B2 | 3/2015 | Prakash et al. |
| 9,006,198 B2 | 4/2015 | Bennett et al. |
| 9,018,368 B2 | 4/2015 | Wilton et al. |
| 9,024,007 B2 | 5/2015 | Wilton et al. |
| 9,035,040 B2 | 5/2015 | Wilton et al. |
| 9,040,674 B2 | 5/2015 | Benson et al. |
| 9,057,066 B2 | 6/2015 | Hung et al. |
| 9,121,020 B2 | 9/2015 | Feinstein et al. |
| 9,126,927 B2 | 9/2015 | Yao et al. |
| 9,127,123 B2 | 9/2015 | Livingston et al. |
| 9,175,286 B2 | 11/2015 | Wilton et al. |
| 9,249,416 B2 | 2/2016 | Wilton et al. |

(56) References Cited

U.S. PATENT DOCUMENTS

| | | |
|---|---|---|
| 9,260,716 B2 | 2/2016 | Davidson et al. |
| 9,273,315 B2 | 3/2016 | Hung et al. |
| 9,284,344 B2 | 3/2016 | Kim et al. |
| 9,308,252 B2 | 4/2016 | Suckow et al. |
| 9,353,372 B2 | 5/2016 | Freier |
| 9,382,575 B2 | 7/2016 | Eom et al. |
| 9,394,333 B2 | 7/2016 | Wada et al. |
| 9,422,555 B2 | 8/2016 | Wilton et al. |
| 9,441,229 B2 | 9/2016 | Wilton et al. |
| 9,447,415 B2 | 9/2016 | Wilton et al. |
| 9,453,228 B2 | 9/2016 | Kandimalla et al. |
| 9,476,044 B2 | 10/2016 | Tuschl et al. |
| 9,480,740 B2 | 11/2016 | Reed et al. |
| 9,598,458 B2 | 3/2017 | Shimizu et al. |
| 9,605,019 B2 | 3/2017 | Verdine et al. |
| 9,605,262 B2 | 3/2017 | Wilton et al. |
| 9,611,472 B2 | 4/2017 | Zamore et al. |
| 9,617,547 B2 | 4/2017 | Gemba |
| 9,695,211 B2 | 7/2017 | Wada et al. |
| 2001/0055761 A1 | 12/2001 | Kanemoto et al. |
| 2002/0013792 A1 | 1/2002 | Imielinski et al. |
| 2002/0082227 A1 | 6/2002 | Henry |
| 2002/0137921 A1 | 9/2002 | Cook |
| 2003/0045705 A1 | 3/2003 | Cook et al. |
| 2003/0049662 A1 | 3/2003 | Monia et al. |
| 2003/0050261 A1 | 3/2003 | Krieg et al. |
| 2003/0232978 A1 | 12/2003 | Seeberger et al. |
| 2003/0235845 A1 | 12/2003 | Van Ommen et al. |
| 2004/0063647 A1 | 4/2004 | Johnson |
| 2004/0203145 A1 | 10/2004 | Zamore et al. |
| 2004/0213780 A1 | 10/2004 | Krainc |
| 2005/0042646 A1 | 2/2005 | Davidson et al. |
| 2005/0059619 A1 | 3/2005 | Krieg et al. |
| 2005/0096284 A1 | 5/2005 | McSwiggen |
| 2005/0159375 A1 | 7/2005 | Srivastava et al. |
| 2005/0169888 A1 | 8/2005 | Hartmann et al. |
| 2005/0176045 A1 | 8/2005 | Fedorov et al. |
| 2005/0239102 A1 | 10/2005 | Verdine et al. |
| 2005/0277133 A1 | 12/2005 | McSwiggen |
| 2005/0277609 A1 | 12/2005 | Krieg et al. |
| 2006/0003962 A1 | 1/2006 | Ahluwalia et al. |
| 2006/0035858 A1 | 2/2006 | Geary et al. |
| 2006/0041115 A1 | 2/2006 | Ravikumar |
| 2006/0063730 A1 | 3/2006 | Monia et al. |
| 2006/0099616 A1 | 5/2006 | van Ommen et al. |
| 2006/0147952 A1 | 7/2006 | van Ommen et al. |
| 2006/0166910 A1 | 7/2006 | Tuschl et al. |
| 2006/0211644 A1 | 9/2006 | Krieg et al. |
| 2006/0257912 A1 | 11/2006 | Kaemmerer et al. |
| 2007/0099860 A1 | 5/2007 | Sah et al. |
| 2007/0123484 A1 | 5/2007 | Bhat et al. |
| 2007/0149462 A1 | 6/2007 | Iyer et al. |
| 2007/0161547 A1 | 7/2007 | Bhat et al. |
| 2007/0161590 A1 | 7/2007 | Van Bilsen et al. |
| 2007/0249589 A1 | 10/2007 | Aebi et al. |
| 2007/0282097 A1 | 12/2007 | Ohgi et al. |
| 2007/0287831 A1 | 12/2007 | Seth et al. |
| 2007/0299027 A1 | 12/2007 | Hung et al. |
| 2008/0015158 A1 | 1/2008 | Ichiro et al. |
| 2008/0015162 A1 | 1/2008 | Bhanot et al. |
| 2008/0039418 A1 | 2/2008 | Freier |
| 2008/0045473 A1 | 2/2008 | Uhlmann et al. |
| 2008/0064867 A1 | 3/2008 | Leuck et al. |
| 2008/0119426 A1 | 5/2008 | Dale |
| 2008/0200409 A1 | 8/2008 | Wilson et al. |
| 2008/0209581 A1 | 8/2008 | van Ommen et al. |
| 2008/0221055 A1 | 9/2008 | Sah et al. |
| 2008/0221303 A1 | 9/2008 | Katzhendler et al. |
| 2008/0249291 A1 | 10/2008 | Kwon et al. |
| 2008/0274989 A1 | 11/2008 | Davidson et al. |
| 2009/0012120 A1 | 1/2009 | Borhan et al. |
| 2009/0023675 A1 | 1/2009 | McSwiggen et al. |
| 2009/0053148 A1 | 2/2009 | Kandimalla et al. |
| 2009/0053205 A1 | 2/2009 | Kandimalla et al. |
| 2009/0060898 A1 | 3/2009 | Kandimalla et al. |
| 2009/0062224 A1 | 3/2009 | Kim et al. |
| 2009/0076246 A1 | 3/2009 | van Deutekom |
| 2009/0093425 A1 | 4/2009 | Dowdy et al. |
| 2009/0162316 A1 | 6/2009 | Verdine et al. |
| 2009/0186410 A1 | 7/2009 | Aronin et al. |
| 2009/0228998 A1 | 9/2009 | van Ommen et al. |
| 2009/0263413 A1 | 10/2009 | Iwamura et al. |
| 2009/0306176 A1 | 12/2009 | Schlingensiepen et al. |
| 2010/0008937 A1 | 1/2010 | Peer et al. |
| 2010/0008981 A1 | 1/2010 | Kaemmerer et al. |
| 2010/0038543 A1 | 2/2010 | Toda et al. |
| 2010/0069472 A1 | 3/2010 | Hung et al. |
| 2010/0120900 A1 | 5/2010 | van Bilsen et al. |
| 2010/0215642 A1 | 8/2010 | Lan et al. |
| 2010/0273999 A1 | 10/2010 | Jung et al. |
| 2010/0299768 A1 | 11/2010 | Perrin et al. |
| 2010/0325746 A9 | 12/2010 | Kaemmerer et al. |
| 2011/0009477 A1 | 1/2011 | Yu et al. |
| 2011/0015253 A1 | 1/2011 | Wilton et al. |
| 2011/0015258 A1 | 1/2011 | Wilton et al. |
| 2011/0039334 A1* | 2/2011 | Bennett .............. C12N 15/111 435/375 |
| 2011/0046203 A1 | 2/2011 | Wilton et al. |
| 2011/0105587 A1 | 5/2011 | Fishcher et al. |
| 2011/0111491 A1 | 5/2011 | Davidson et al. |
| 2011/0136765 A1 | 6/2011 | Promo et al. |
| 2011/0178284 A1 | 7/2011 | Wada et al. |
| 2011/0201599 A1 | 8/2011 | Bahceci et al. |
| 2011/0212520 A1 | 9/2011 | Davidson et al. |
| 2011/0213010 A1 | 9/2011 | Hayden et al. |
| 2011/0257251 A1 | 10/2011 | Gude-Rodriguez et al. |
| 2011/0263686 A1 | 10/2011 | Wilton et al. |
| 2011/0269814 A1 | 11/2011 | Manoharan et al. |
| 2011/0294124 A1 | 12/2011 | Wada et al. |
| 2011/0294869 A1 | 12/2011 | Petersen |
| 2011/0306652 A1 | 12/2011 | Freier |
| 2011/0312086 A1 | 12/2011 | Van Deutekom |
| 2012/0022144 A1 | 1/2012 | Wilton et al. |
| 2012/0022145 A1 | 1/2012 | Wilton et al. |
| 2012/0029057 A1 | 2/2012 | Wilton et al. |
| 2012/0029058 A1 | 2/2012 | Wilton et al. |
| 2012/0029059 A1 | 2/2012 | Wilton et al. |
| 2012/0029060 A1 | 2/2012 | Wilton et al. |
| 2012/0041050 A1 | 2/2012 | Wilton et al. |
| 2012/0095076 A1 | 4/2012 | Sah et al. |
| 2012/0136039 A1 | 5/2012 | Aronin et al. |
| 2012/0156138 A1 | 6/2012 | Smith |
| 2012/0208864 A1 | 8/2012 | Bhanot et al. |
| 2012/0246747 A1 | 9/2012 | Tuschl et al. |
| 2012/0252879 A1 | 10/2012 | Hung et al. |
| 2012/0308609 A1 | 12/2012 | Gibbon et al. |
| 2012/0316224 A1 | 12/2012 | Verdine et al. |
| 2013/0005794 A1 | 1/2013 | Kaemmerer et al. |
| 2013/0046008 A1 | 2/2013 | Bennett et al. |
| 2013/0072671 A1 | 3/2013 | Van Deutekom |
| 2013/0116310 A1 | 5/2013 | Wilton et al. |
| 2013/0178612 A1 | 7/2013 | Wada et al. |
| 2013/0184450 A1 | 7/2013 | Wada et al. |
| 2013/0189782 A1 | 7/2013 | Hung et al. |
| 2013/0197061 A1 | 8/2013 | Hohjoh et al. |
| 2013/0217755 A1 | 8/2013 | Wilton et al. |
| 2013/0236536 A1 | 9/2013 | Phiasivongsa et al. |
| 2013/0253033 A1 | 9/2013 | Wilton et al. |
| 2013/0253178 A1 | 9/2013 | Shimizu et al. |
| 2013/0253180 A1 | 9/2013 | Wilton et al. |
| 2013/0274313 A1 | 10/2013 | Wilton et al. |
| 2013/0281684 A1 | 10/2013 | Freier |
| 2013/0302806 A1 | 11/2013 | Van Deutekom |
| 2013/0323836 A1 | 12/2013 | Manoharan et al. |
| 2013/0331438 A1 | 12/2013 | Wilton et al. |
| 2014/0080896 A1 | 3/2014 | Nelson et al. |
| 2014/0080898 A1 | 3/2014 | Wilton et al. |
| 2014/0107330 A1 | 4/2014 | Freier et al. |
| 2014/0120088 A1 | 5/2014 | Carpentier |
| 2014/0142160 A1 | 5/2014 | Lee et al. |
| 2014/0155587 A1 | 6/2014 | Wilton et al. |
| 2014/0163213 A1 | 6/2014 | Debelak et al. |
| 2014/0194610 A1 | 7/2014 | Verdine et al. |
| 2014/0213635 A1 | 7/2014 | Van Deutekom |

(56) References Cited

U.S. PATENT DOCUMENTS

| | | |
|---|---|---|
| 2014/0221395 A1 | 8/2014 | Dhanoa |
| 2014/0243515 A1 | 8/2014 | Wilton et al. |
| 2014/0243516 A1 | 8/2014 | Wilton et al. |
| 2014/0256578 A1 | 9/2014 | Hayden et al. |
| 2014/0275212 A1 | 9/2014 | van Deutekom |
| 2014/0309283 A1 | 10/2014 | Wilton et al. |
| 2014/0309284 A1 | 10/2014 | Wilton et al. |
| 2014/0309285 A1 | 10/2014 | Wilton et al. |
| 2014/0323707 A1 | 10/2014 | Seth et al. |
| 2014/0350076 A1 | 11/2014 | van Deutkom |
| 2014/0357698 A1 | 12/2014 | Van Deutekom et al. |
| 2014/0357855 A1 | 12/2014 | Van Deutekom et al. |
| 2014/0373188 A1 | 12/2014 | Zamore et al. |
| 2014/0378527 A1 | 12/2014 | van Deutekom |
| 2015/0051389 A1 | 2/2015 | Seth et al. |
| 2015/0057330 A1 | 2/2015 | Wilton et al. |
| 2015/0080563 A2 | 3/2015 | van Deutekom |
| 2015/0096064 A1 | 4/2015 | Tuschl et al. |
| 2015/0166999 A1 | 6/2015 | Gemba |
| 2015/0197540 A1 | 7/2015 | Shimizu et al. |
| 2015/0218559 A1 | 8/2015 | Van Deutekom et al. |
| 2015/0275208 A1 | 10/2015 | Oestergaard et al. |
| 2015/0292015 A1 | 10/2015 | Bennett et al. |
| 2015/0307877 A1 | 10/2015 | Freier |
| 2015/0322434 A1 | 11/2015 | van Deutekom |
| 2015/0329859 A1 | 11/2015 | Bennett et al. |
| 2015/0335708 A1 | 11/2015 | Froelich et al. |
| 2015/0353931 A1 | 12/2015 | Wilton et al. |
| 2015/0361424 A1 | 12/2015 | van Deutekom |
| 2015/0376615 A1 | 12/2015 | Wilton et al. |
| 2015/0376616 A1 | 12/2015 | Wilton et al. |
| 2015/0376624 A1 | 12/2015 | Gryaznov et al. |
| 2015/0376625 A1 | 12/2015 | Oestergaard et al. |
| 2016/0002631 A1 | 1/2016 | Wilton et al. |
| 2016/0002632 A1 | 1/2016 | Wilton et al. |
| 2016/0002635 A1 | 1/2016 | Wilton et al. |
| 2016/0017327 A1 | 1/2016 | Rudnicki et al. |
| 2016/0040161 A1 | 2/2016 | Packard et al. |
| 2016/0053256 A1 | 2/2016 | Hung et al. |
| 2016/0076033 A1 | 3/2016 | Torii et al. |
| 2016/0138022 A1 | 5/2016 | Kandimalla et al. |
| 2016/0168570 A1 | 6/2016 | Van Deutekom et al. |
| 2016/0186175 A1 | 6/2016 | Seth et al. |
| 2016/0186178 A1 | 6/2016 | Radovic-Moreno et al. |
| 2016/0186185 A1 | 6/2016 | Prakash et al. |
| 2016/0194349 A1 | 7/2016 | Prakash et al. |
| 2016/0194636 A1 | 7/2016 | Van Deutekom et al. |
| 2016/0251653 A1 | 9/2016 | Davidson et al. |
| 2016/0251658 A1 | 9/2016 | Van Deutekom et al. |
| 2016/0264964 A1 | 9/2016 | Cancilla et al. |
| 2016/0312217 A1 | 10/2016 | Hung et al. |
| 2016/0331835 A1 | 11/2016 | Gemba et al. |
| 2016/0331836 A1 | 11/2016 | Gemba et al. |
| 2016/0333349 A1 | 11/2016 | Gemba et al. |
| 2016/0347780 A1 | 12/2016 | Wada et al. |
| 2016/0347784 A1 | 12/2016 | Verdine et al. |
| 2016/0355810 A1 | 12/2016 | Van Deutekom |
| 2016/0369273 A1 | 12/2016 | Freier |
| 2017/0009233 A1 | 1/2017 | Wilton et al. |
| 2017/0009234 A1 | 1/2017 | Wilton et al. |
| 2017/0029445 A1 | 2/2017 | Shimizu et al. |
| 2017/0029457 A1 | 2/2017 | Verdine et al. |
| 2017/0037399 A1 | 2/2017 | Meena et al. |
| 2017/0044526 A1 | 2/2017 | Wan et al. |
| 2017/0067050 A1 | 3/2017 | Tuschl et al. |
| 2017/0130224 A1 | 5/2017 | Oestergaard et al. |
| 2017/0275621 A1 | 9/2017 | Butler et al. |

FOREIGN PATENT DOCUMENTS

| | | |
|---|---|---|
| DE | 1144279 B | 2/1963 |
| DE | 01934150 A1 | 1/1970 |
| DE | 133885 A1 | 1/1979 |
| EA | 008940 B1 | 10/2007 |
| EP | 0 002 322 A2 | 6/1979 |
| EP | 192521 A1 | 8/1986 |
| EP | 269258 A2 | 6/1988 |
| EP | 0506242 A1 | 9/1992 |
| EP | 0531447 A1 | 3/1993 |
| EP | 0604409 A1 | 7/1994 |
| EP | 0655088 A1 | 5/1995 |
| EP | 0779893 A2 | 6/1997 |
| EP | 0831854 A1 | 4/1998 |
| EP | 0973945 A1 | 1/2000 |
| EP | 1097162 A2 | 5/2001 |
| EP | 1100807 A1 | 5/2001 |
| EP | 1185305 A0 | 3/2002 |
| EP | 1244682 A1 | 10/2002 |
| EP | 1311526 A1 | 5/2003 |
| EP | 1418179 A2 | 5/2004 |
| EP | 1499627 A2 | 1/2005 |
| EP | 1539188 A2 | 6/2005 |
| EP | 1556077 A2 | 7/2005 |
| EP | 1560840 A2 | 8/2005 |
| EP | 1562971 A2 | 8/2005 |
| EP | 1670810 A2 | 6/2006 |
| EP | 1670896 A2 | 6/2006 |
| EP | 1795536 A1 | 6/2007 |
| EP | 1957507 A2 | 8/2008 |
| EP | 1984381 A2 | 10/2008 |
| EP | 2021472 A2 | 2/2009 |
| EP | 2062980 A2 | 5/2009 |
| EP | 2066684 A2 | 6/2009 |
| EP | 2149571 A1 | 2/2010 |
| EP | 2161038 A1 | 3/2010 |
| EP | 2170917 A2 | 4/2010 |
| EP | 2173760 A2 | 4/2010 |
| EP | 2176280 A2 | 4/2010 |
| EP | 2282744 A1 | 2/2011 |
| EP | 2285819 A1 | 2/2011 |
| EP | 2316967 A1 | 5/2011 |
| EP | 2360166 A1 | 8/2011 |
| EP | 1 866 319 B1 | 11/2011 |
| EP | 2399588 A1 | 12/2011 |
| EP | 2422819 A2 | 2/2012 |
| EP | 2428227 A1 | 3/2012 |
| EP | 2462153 A2 | 6/2012 |
| EP | 2479182 A1 | 7/2012 |
| EP | 1606407 B1 | 12/2012 |
| EP | 14193887.8 | 11/2014 |
| EP | 14198167.0 | 12/2014 |
| EP | 15182401.8 | 8/2015 |
| EP | 15191074.2 | 10/2015 |
| EP | 15191075.9 | 10/2015 |
| EP | 15191076.7 | 10/2015 |
| EP | 2982758 A1 | 2/2016 |
| EP | 2125852 B1 | 4/2016 |
| EP | 2370451 B1 | 11/2016 |
| EP | 2 534 262 B1 | 12/2016 |
| GB | 1448437 A | 9/1976 |
| GB | 2016273 A | 9/1979 |
| JP | 3072345 B1 | 7/2000 |
| JP | 2003/238586 A | 8/2003 |
| JP | 2009-190983 A | 8/2009 |
| JP | 4348044 B2 | 10/2009 |
| JP | 04348077 B2 | 10/2009 |
| JP | 2010/241836 A | 10/2010 |
| JP | 2010/265304 A | 11/2010 |
| JP | A03-074398 | 3/2011 |
| JP | 2011/088935 A | 5/2011 |
| JP | 2011/225598 A | 11/2011 |
| RU | 2145964 C1 | 2/2000 |
| WO | WO-91/10671 A1 | 7/1991 |
| WO | WO-91/16331 A1 | 10/1991 |
| WO | WO-91/17755 A1 | 11/1991 |
| WO | WO-93/08296 A1 | 4/1993 |
| WO | WO-94/17093 A1 | 8/1994 |
| WO | WO-94/22890 A1 | 10/1994 |
| WO | WO-96/02555 A1 | 2/1996 |
| WO | WO-96/07392 A2 | 3/1996 |
| WO | WO-96/14329 A1 | 5/1996 |
| WO | WO-96/19572 A1 | 6/1996 |
| WO | WO-96/37504 A1 | 11/1996 |
| WO | WO-96/39413 A1 | 12/1996 |

(56) References Cited

FOREIGN PATENT DOCUMENTS

| | | |
|---|---|---|
| WO | WO-97/06183 A1 | 2/1997 |
| WO | WO-97/09443 A1 | 3/1997 |
| WO | WO-97/14710 A1 | 4/1997 |
| WO | WO-97/47637 A1 | 12/1997 |
| WO | WO-98/02582 A2 | 1/1998 |
| WO | WO-98/03542 A1 | 1/1998 |
| WO | WO-98/07734 A1 | 2/1998 |
| WO | WO-98/18810 A1 | 5/1998 |
| WO | WO-98/39334 A1 | 9/1998 |
| WO | WO-98/46794 A1 | 10/1998 |
| WO | WO-98/53801 A1 | 12/1998 |
| WO | WO-99/05160 A2 | 2/1999 |
| WO | WO-99/12034 A1 | 3/1999 |
| WO | WO-99/56755 A1 | 11/1999 |
| WO | WO-99/58118 A2 | 11/1999 |
| WO | WO-00/00499 A1 | 1/2000 |
| WO | WO-00/04034 A2 | 1/2000 |
| WO | WO-00/06588 A1 | 2/2000 |
| WO | WO-00/09159 A1 | 2/2000 |
| WO | WO-00/23444 A1 | 4/2000 |
| WO | WO-00/31110 A1 | 6/2000 |
| WO | WO-00/37658 A2 | 6/2000 |
| WO | WO-00/55179 A1 | 9/2000 |
| WO | WO-00/58329 A1 | 10/2000 |
| WO | WO-00/76554 A1 | 12/2000 |
| WO | WO-01/02415 A1 | 1/2001 |
| WO | WO-01/022990 A2 | 4/2001 |
| WO | WO-01/27126 A1 | 4/2001 |
| WO | WO-01/40515 A1 | 6/2001 |
| WO | WO-01/49701 A1 | 7/2001 |
| WO | WO-01/64702 A1 | 9/2001 |
| WO | WO-01/81303 A1 | 11/2001 |
| WO | WO-01/85751 A1 | 11/2001 |
| WO | WO-01/88198 A1 | 11/2001 |
| WO | WO-02/14340 A1 | 2/2002 |
| WO | WO-02/15410 A2 | 2/2002 |
| WO | WO-02/20544 A1 | 3/2002 |
| WO | WO-02/22635 A1 | 3/2002 |
| WO | WO-02/24906 A1 | 3/2002 |
| WO | WO-02/32450 A1 | 4/2002 |
| WO | WO-02/57425 A2 | 7/2002 |
| WO | WO-2002/051716 A1 | 7/2002 |
| WO | WO-02/97134 A2 | 12/2002 |
| WO | WO-02/099317 A1 | 12/2002 |
| WO | WO-03/002065 A2 | 1/2003 |
| WO | WO-03/004602 A2 | 1/2003 |
| WO | WO-03/011887 A2 | 2/2003 |
| WO | WO-03/012057 A2 | 2/2003 |
| WO | WO-03/014306 A2 | 2/2003 |
| WO | WO-03/014307 A2 | 2/2003 |
| WO | WO-03/018600 A2 | 3/2003 |
| WO | WO-03/066633 A1 | 8/2003 |
| WO | WO-03/097662 A1 | 11/2003 |
| WO | WO-03/099840 A1 | 12/2003 |
| WO | WO-03/100017 A2 | 12/2003 |
| WO | WO-03/106477 A1 | 12/2003 |
| WO | WO-2004/000351 A1 | 12/2003 |
| WO | WO-2004/003228 A1 | 1/2004 |
| WO | WO-2004/007718 A2 | 1/2004 |
| WO | WO-2004/014933 A1 | 2/2004 |
| WO | WO-2004/016805 A2 | 2/2004 |
| WO | WO-2004010956 A2 | 2/2004 |
| WO | WO-2004/024919 A1 | 3/2004 |
| WO | WO-2004/039829 A2 | 5/2004 |
| WO | WO-2004041889 A2 | 5/2004 |
| WO | WO-2004/044134 A2 | 5/2004 |
| WO | WO-2004/044136 A2 | 5/2004 |
| WO | WO-2004/044141 A2 | 5/2004 |
| WO | WO-2004/044181 A2 | 5/2004 |
| WO | WO-2004/048522 A2 | 6/2004 |
| WO | WO-2004/055162 A2 | 7/2004 |
| WO | WO-2004/083432 A1 | 9/2004 |
| WO | WO-2004/083446 A2 | 9/2004 |
| WO | WO-2004/085454 A1 | 10/2004 |
| WO | WO-2004/093783 A2 | 11/2004 |
| WO | WO-2005000201 A2 | 1/2005 |
| WO | WO-2005005599 A2 | 1/2005 |
| WO | WO-2005/014609 A2 | 2/2005 |
| WO | WO-2005/013901 A2 | 2/2005 |
| WO | WO-2005/023828 A1 | 3/2005 |
| WO | WO-2005/028494 A1 | 3/2005 |
| WO | WO-2005019418 A2 | 3/2005 |
| WO | WO-2005023825 A2 | 3/2005 |
| WO | WO-2005023995 A2 | 3/2005 |
| WO | WO-2005/039630 A2 | 5/2005 |
| WO | WO-2005/042018 A2 | 5/2005 |
| WO | WO-2005/042716 A2 | 5/2005 |
| WO | WO-2005/070859 A1 | 8/2005 |
| WO | WO-2005/085272 A1 | 9/2005 |
| WO | WO-2005/092909 A1 | 10/2005 |
| WO | WO-2006/000057 A1 | 1/2006 |
| WO | WO-2006020676 A2 | 2/2006 |
| WO | WO-2006/022323 A1 | 3/2006 |
| WO | WO-2006/029258 A2 | 3/2006 |
| WO | WO-2006/031267 A2 | 3/2006 |
| WO | WO-2006031461 A2 | 3/2006 |
| WO | WO-2006044531 A2 | 4/2006 |
| WO | WO-2006/049454 A1 | 5/2006 |
| WO | WO-2006/053861 A1 | 5/2006 |
| WO | WO-2006/065751 A1 | 6/2006 |
| WO | WO-2006/066260 A2 | 6/2006 |
| WO | WO-2006/070284 A1 | 7/2006 |
| WO | WO-2006/080596 A1 | 8/2006 |
| WO | WO-2006/091915 A2 | 8/2006 |
| WO | WO-2006/117400 A2 | 11/2006 |
| WO | WO-2006/121960 A2 | 11/2006 |
| WO | WO-2007/002904 A2 | 1/2007 |
| WO | WO-2007/005941 A2 | 1/2007 |
| WO | WO-2007/027775 A2 | 3/2007 |
| WO | WO-2007/041045 A2 | 4/2007 |
| WO | WO-2007/051045 A2 | 5/2007 |
| WO | WO-2007/059041 A2 | 5/2007 |
| WO | WO-2007/064291 A1 | 6/2007 |
| WO | WO-2007/064954 A2 | 6/2007 |
| WO | WO-2007/070598 A2 | 6/2007 |
| WO | WO-2007/089584 A2 | 8/2007 |
| WO | WO-2007/089611 A2 | 8/2007 |
| WO | WO-2007/090071 A2 | 8/2007 |
| WO | WO-2007/095316 A2 | 8/2007 |
| WO | WO-2007/131232 A2 | 11/2007 |
| WO | WO-2007/131237 A2 | 11/2007 |
| WO | WO-2007/131238 A2 | 11/2007 |
| WO | WO-2007/134014 A2 | 11/2007 |
| WO | WO-2007/136988 A2 | 11/2007 |
| WO | WO-2007/139190 A1 | 12/2007 |
| WO | WO-2007/143315 A2 | 12/2007 |
| WO | WO-2007/143316 A2 | 12/2007 |
| WO | WO-2007/143317 A2 | 12/2007 |
| WO | WO-2007/146511 A2 | 12/2007 |
| WO | WO-2008/005562 A2 | 1/2008 |
| WO | WO-2008/008476 A2 | 1/2008 |
| WO | WO-2008/017081 A1 | 2/2008 |
| WO | WO-2008/021136 A2 | 2/2008 |
| WO | WO-2008/049085 A1 | 4/2008 |
| WO | WO-2008/051763 A1 | 5/2008 |
| WO | WO-2008/066776 A2 | 6/2008 |
| WO | WO-2008/068638 A2 | 6/2008 |
| WO | WO-2008/073959 A2 | 6/2008 |
| WO | WO-2008/098104 A1 | 8/2008 |
| WO | WO-2008/118883 A1 | 10/2008 |
| WO | WO-2008/139262 A2 | 11/2008 |
| WO | WO-2008/148801 A1 | 12/2008 |
| WO | WO-2008/151833 A2 | 12/2008 |
| WO | WO-2009/007855 A2 | 1/2009 |
| WO | WO-2009/046141 A2 | 4/2009 |
| WO | WO-2009/086264 A1 | 7/2009 |
| WO | WO-2009/089659 A1 | 7/2009 |
| WO | WO-2009/089689 A1 | 7/2009 |
| WO | WO-2009/098197 A1 | 8/2009 |
| WO | WO-2009/117589 A1 | 9/2009 |
| WO | WO-2009/124238 A1 | 10/2009 |
| WO | WO-2009/135322 A1 | 11/2009 |
| WO | WO-2009143387 A2 | 11/2009 |
| WO | WO-2009143390 A2 | 11/2009 |

(56) References Cited

FOREIGN PATENT DOCUMENTS

| | | |
|---|---|---|
| WO | WO-2009143391 A2 | 11/2009 |
| WO | WO-2009143463 A2 | 11/2009 |
| WO | WO-2009/146123 A2 | 12/2009 |
| WO | WO-2009148605 A2 | 12/2009 |
| WO | WO-2010/003133 A2 | 1/2010 |
| WO | WO-2010/039543 A2 | 4/2010 |
| WO | WO-2010/042636 A2 | 4/2010 |
| WO | WO-2010036696 A1 | 4/2010 |
| WO | WO-2010036698 A1 | 4/2010 |
| WO | WO-2010/048552 A2 | 4/2010 |
| WO | WO-2010/064146 A2 | 6/2010 |
| WO | WO-2010/072831 A1 | 7/2010 |
| WO | WO-2010080953 A1 | 7/2010 |
| WO | WO-2010091301 A1 | 8/2010 |
| WO | WO-2010107838 A1 | 9/2010 |
| WO | WO-2010/118263 A1 | 10/2010 |
| WO | WO-2010120262 A1 | 10/2010 |
| WO | WO-2010/129853 A2 | 11/2010 |
| WO | WO-2010/141471 A2 | 12/2010 |
| WO | WO-2011/005761 A1 | 1/2011 |
| WO | WO-2011/005764 A1 | 1/2011 |
| WO | WO-2011/005860 A2 | 1/2011 |
| WO | WO-2011/015572 A1 | 2/2011 |
| WO | WO-2011/015573 A1 | 2/2011 |
| WO | WO-2011017521 A2 | 2/2011 |
| WO | WO-2011/034072 A1 | 3/2011 |
| WO | WO-2011038288 A1 | 3/2011 |
| WO | WO-2011/045702 A1 | 4/2011 |
| WO | WO-2011085271 A2 | 7/2011 |
| WO | WO-2011/097643 A1 | 8/2011 |
| WO | WO-2011/097644 A2 | 8/2011 |
| WO | WO-2011/108682 A1 | 9/2011 |
| WO | WO-2011/133871 A2 | 10/2011 |
| WO | WO-2011127175 A1 | 10/2011 |
| WO | WO-2011127307 A1 | 10/2011 |
| WO | WO-2011/139699 A2 | 11/2011 |
| WO | WO-2011/139911 A2 | 11/2011 |
| WO | WO-2012/030683 A2 | 3/2012 |
| WO | WO-2012/039448 A1 | 3/2012 |
| WO | WO-2012/073857 A1 | 6/2012 |
| WO | WO-2012/151324 A1 | 11/2012 |
| WO | WO-2013/012758 A1 | 1/2013 |
| WO | WO-2013/022984 A1 | 2/2013 |
| WO | WO-2013/022990 A1 | 2/2013 |
| WO | WO-2014/010250 A1 | 1/2014 |
| WO | WO-2014/010718 A1 | 1/2014 |
| WO | WO-2014/012081 A2 | 1/2014 |
| WO | WO-2014/025805 A1 | 2/2014 |
| WO | WO-2014/028739 A1 | 2/2014 |
| WO | WO-2014/059356 A2 | 4/2014 |
| WO | WO-2014/076195 A1 | 5/2014 |
| WO | WO-2014/076196 A1 | 5/2014 |
| WO | WO-2014/080004 A1 | 5/2014 |
| WO | WO-2014/118267 A1 | 8/2014 |
| WO | WO-2014/118272 A1 | 8/2014 |
| WO | WO-2014/179626 A2 | 11/2014 |
| WO | WO-2014/188001 A1 | 11/2014 |
| WO | WO-2014/207232 A1 | 12/2014 |
| WO | WO-2015/010135 A2 | 1/2015 |
| WO | WO-2015/051214 A1 | 4/2015 |
| WO | WO-2015/051366 A2 | 4/2015 |
| WO | WO-2015/070212 A1 | 5/2015 |
| WO | WO-2015/071388 A1 | 5/2015 |
| WO | WO-2015/089511 A2 | 6/2015 |
| WO | WO-2015/107425 A2 | 7/2015 |
| WO | WO-2015/108046 A1 | 7/2015 |
| WO | WO-2015/108047 A1 | 7/2015 |
| WO | WO-2015/108048 A1 | 7/2015 |
| WO | WO-2015/168172 A1 | 11/2015 |
| WO | WO-2015/171932 A1 | 11/2015 |
| WO | WO-2015/179525 A1 | 11/2015 |
| WO | WO-2016/011226 A1 | 1/2016 |
| WO | WO-2016/020399 A1 | 2/2016 |
| WO | WO-2016/027168 A2 | 2/2016 |
| WO | WO-2016/037191 A1 | 3/2016 |
| WO | WO-2016/079181 A1 | 5/2016 |
| WO | WO-2016/079183 A1 | 5/2016 |
| WO | WO-2016/096938 A1 | 6/2016 |
| WO | WO-2016/102664 A1 | 6/2016 |
| WO | WO-2016/127000 A1 | 8/2016 |
| WO | WO-2016/127002 A1 | 8/2016 |
| WO | WO-2016/130589 A2 | 8/2016 |
| WO | WO-2016/130806 A2 | 8/2016 |
| WO | WO-2016/138017 A1 | 9/2016 |
| WO | WO-2016/141236 A1 | 9/2016 |
| WO | WO-2016/154096 A1 | 9/2016 |
| WO | WO-2016/161374 A1 | 10/2016 |
| WO | WO-2016/164896 A2 | 10/2016 |
| WO | WO-2016/167780 A1 | 10/2016 |
| WO | WO-2016/209862 A1 | 12/2016 |
| WO | WO-2017/004261 A1 | 1/2017 |
| WO | WO-2017/011276 A1 | 1/2017 |
| WO | WO-2017/011286 A1 | 1/2017 |
| WO | WO-2017/015109 A1 | 1/2017 |
| WO | WO-2017/015555 | 1/2017 |
| WO | WO-2017/015575 | 1/2017 |
| WO | WO-2017/019660 A1 | 2/2017 |
| WO | WO-2017/023660 A1 | 2/2017 |
| WO | WO-2017/032726 A1 | 3/2017 |
| WO | WO-2017/035340 A1 | 3/2017 |
| WO | WO-2017/040078 A1 | 3/2017 |
| WO | WO-2017/055423 A1 | 4/2017 |
| WO | WO-2017/062862 A2 | 4/2017 |
| WO | WO-2017/067970 A1 | 4/2017 |
| WO | WO-2017/068087 A1 | 4/2017 |
| WO | WO-2017/081223 A1 | 5/2017 |
| WO | WO-2017/157672 A1 | 9/2017 |
| WO | WO-2017/157899 A1 | 9/2017 |
| WO | WO-2017/160741 A1 | 9/2017 |
| WO | WO-2017/178656 A1 | 10/2017 |
| WO | WO-2017/192679 A1 | 11/2017 |
| WO | WO-2017/194498 A1 | 11/2017 |
| WO | WO-2017/194664 A1 | 11/2017 |
| WO | WO-2017/210647 A1 | 12/2017 |

OTHER PUBLICATIONS

Dellinger, D.J. et al., Streamlined Process for the Chemical Synthesis of RNA Using 2'-O-Thionocarbamate-Protected Nucleoside Phosphoramidites in the Solid Phase, J. Am. Chem. Soc., 133: 11540-11556 (2011).

Documents submitted to the U.S. Securities and Exchange Commission (SEC), Wave Life Sciences Ltd. CIK#: 0001631574 (2015-). Additional documents available through EDGAR of SEC, URL: <http://www.sec.gov/cgi-bin/browse-edgar?company=wave+life+sciences&owner=exclude&action=getcompany>.

Egli, M. et al., Probing the Influence of Stereoelectronic Effects on the Biophysical Properties of Oligonucleotides: Comprehensive Analysis of the RNA Affinity, Nuclease Resistance, and Crystal Structure of Ten 2'-O-Ribonucleic Acid Modifications, Biochemistry, 44: 9045-9057 (2005).

File Registry on STN, RN 18217-60-2, Entered STN: Nov. 16, 1984.

File Registry on STN, RN 871246-91-2, Entered STN: Jan. 5, 2006.

Ganguly, A.K. et al., Structure of Halomicin B, J.C.S. Chem. Comm., 395-396 (1974).

Gijsen, H.J.M et al., Development of two diastereoselective rougtes towards trans-4-aminomethyl-piperidin-3-ol building blocks, Tetrahedron 64(10): 2456-2464 (2008).

Guo, M. et al., Solid-phase stereoselective synthesis of 2'-O-methyl-oligo-ribonucleoside phosphorothioates using nucleoside bicyclic oxazaphospholidines, Biorganic & Medicinal Chemistry Letters, 8(18):2539-2544 (1998).

Hansen et al., Azaribofuranoside Analogues as Designed Inhibitors of Purine Nucleoside Phosphorylase, Synthesis and Biological Evaluation, Acta Chemis Scandinavica 52: 1214-1222 (1998).

International Preliminary Report on Patentability and Written Opinion of the Searching Authority for PCT/JP2011/055018 dated (Oct. 11, 2012) with English Translation thereof.

(56) References Cited

OTHER PUBLICATIONS

International Preliminary Report on Patentability for Application No. PCT/JP2010/065900, 6 pages dated Mar. 29, 2012).
International Preliminary Report on Patentability for Application No. PCT/JP2010/065900, 7 pages dated (Apr. 19, 2012). (English Translation).
International Preliminary Report on Patentability for Application No. PCT/JP2011/071559, 7 pages dated (Apr. 25, 2014).
International Preliminary Report on Patentability for PCT/JP2013/004303, 1 page dated (Jan. 13, 2015).
International Search Report for PCT/IB2015/000395, 7 pages dated (Oct. 30, 2015).
International Search Report for PCT/JP11/71559, 3 pages dated (Dec. 20, 2011).
International Search Report for PCT/JP2010/065900, 1 page dated (Sep. 15, 2010).
International Search Report for PCT/JP2011/077313, 2 pages dated (Jan. 10, 2012).
International Search Report for PCT/JP2011/55018 dated (Mar. 29, 2011).
International Search Report for PCT/JP2013/004303, 3 pages dated (Aug. 13, 2013).
Kihara, M et al., New norepinephrine potentiators: synthesis and structure-actvity relasntionships of a series of 4-phenyl-1,2,3,4-tetrahydroisoquinolin-4-ols, Chemical & Pharmaceutical Bulletin 42(1): 67-73 (1994).
Kiviniemi, A. et al., Solid-Supported 2'-O-Glycoconjugation of Oligonucleotides by Azidation and Click Reactions, Bioconjugate Chemistry, 22(6): 1249-1255 (2011).
Machine Translation of JP 2010-265304 (2010). <http://dossier1.ipd.go.jp/AIPN/odse_top_dn.ipdl?NOOOO=7400>.
Matysiak, S et al., Acetals as New 2'-O-Protecting Functions for the Synthesis of the Oligoribonucleotides: Synthesis of Uridine Building Blocks and Evaluatino of Their Relative Acid Stability, Helvetica Chimica Acta 81: 1545-1566 (1998).
Misaki, S et al., Dehydration of 2-Trifluoromethyl-3,3,3-Trifluoropropanil with Base, Journal of Flourine Chemistry 24: 531-533 (1984).
Oka, N. et al., Stereocontrolled synthesis of oligonucleoside phosphorothioates and PO/PS-chimeric oligonucleotides by using oxazaphospholidine derivatives, Nucleic Acids Symposium Series, 52: 335-336 (2008).
Parrish et al., Functional Anatomy of a dsRNA Trigger: Differential Requirement for the Two Trigger Strands in RNA Interference, Molecular Cell, 6:1077-1087 (2000).
Pontiggia, R. et al., 2-C-Methyluridine modified hammerhead riboxyme against the estrogen receptor, Bioorganic & Medicinal Chemistry Letters, 20: 2806-2808 (2010).
Pontiggia, R. et al., DNAzymes and ribozymes carrying 2'-C-methyl nucleotides, Nucleic Acids Sumposium Series, 52: 521-522 (2008).
Potter et al, Stereospecificity of nucleases towards phosphorothioate-substituted RNA: stereochemistry of transcription by T7 RNA polymerase, Nucleinc Acids Research, 15(10): 4145-4162 (1987).
Puri, N. et al., The Synthesis and Reactivity of New 2-(N,N-Diisoprophylamino)-3-Methylsulfonyl-1,3,2-Benzoxazaphospholes. The Utility of the 5-Chloro analogue in the One-Pot Synthesis of Oligothiophosphates: [ApsppA, ApspppA, ppp5'A2'ps5'A, m7GpsppA, Apspppp, Apspp], Tetrahedron 51(10): 2991-3014 (1995).
Rozners, E. et al., Evaluation of 2'-hydroxyl protection in RNA-synthesis using the H-phosphonate appraod, Nucleic Acids Research, 22(1): 94-99 (1994).
Sakatsume, O. et al., Solid Phase Synthesis of Oligoribonucleotides by the Phosphoramidite Approach Using 2'-O-1-(2-Chloroethoxy)Ethyl Protection, Tetrahedron, 47(41): 8717-8728 (1991).
Saneyoshi, H. et al., A General Method for the Synthesis of 2'-0-Cyanoethylated Oligoribonucleotides Having Promising Hybridization Affinity for DNA and RNA and Enhanced Nuclease Resistance, The Journal of Organic Chemistry, 70(25): 10453-10460 (2005).
Sierzchala et al., Oxathiaphospholane Method of Stereocontrolled Synthesis of Diribonucleoside 3', 5'—Phosphorotioates, Journal of Organic Chemistry 61(19): 6713-6716 (1996).
Sproat, B.S., RNA Synthesis Using 2'-O-(Tert-Butyldimethylsilyl) Protection, Methods in Molecular Biology, 288: 17-31 (2005).
Umemoto, T et al., Oligoribonucleotide Synthesis by the use of 1-(2-cyanoethoxy)ethyl (CEE) as a 2'-hydroxy protecting group, Tetrahedron Letters 45: 9529-9531 (2004).
Usman, N. et al., Automated Chemical Synthesis of Long Oligoribonucleotides Using 2'-O-Siylylated Ribonucleoside 3'-O-Phosphoramidites on a Controlled-Pore Glass Support, J. Am. Chem. Soc. 109(25): 7845-7854 (1987).
Wada, Takeshi, Chapter I Development of nucleic acid medicines, 3.3 Chemical synthesis of phosphorous atom-modified nucleic acids, CMC Publication., Frontier of Development of Nucleic Acid Medicine: 67-75 (2009).
Welz et al., 5-(Benzylmercapto)-1H-tetrazole as activator for 2'-O-TBDMS phosphoramidite building blocks in RNA synthesis, Tetrahedron Letters, 43: 795-797 (2002).
Wong, Chui Ming, Synthesis of anisomycin. Part I. The stereospecific synthesis of N-benzoyl-2-(p-methoxybenzyl)-3-hydroxy-4-carboxamido pyrrolidine and the absolute configuration of anisomycin, Canadian journal of Chemistry 46: 1101-1104 (1968).
Written Opinion for PCT/IB2015/000395, 10 pages dated (Oct. 30, 2015).
Written Opinion for PCT/JP11/55018, 3 pages dated (Mar. 29, 2011).
Written Opinion for PCT/JP11/71559, 6 pages dated (Dec. 20, 2011).
Written Opinion for PCT/JP2010/065900, 5 pages dated (Sep. 15, 2010).
Written Opinion for PCT/JP2013/004303, 6 pages dated (Aug. 13, 2013).
Wu, X. et al., Synthesis of 5'-C- and 2'-O-(Bromoalkyl)-Substituted Ribonucleoside Phosphoramidites for the Post-synthetic Functionalization of Oligonucleotides on Solid Support, Helvetica Chimica Acta, 83: 1127-1144 (2000).
Yamakage, S-i. et al., 1-(2-Chloroethoxy)Ethyl Group for the Protection of 2'-Hydroxyl Group in the Synthesis of Oligoribonucleotides, Tetrahedron Letters, 30(46): 6361-6364 (1989).
Yu, S. et al., A One-Pot Formal [4 + 2] Cycloaddition Approach to Substituted Piperidines, Indolizidines, and Quinolizidines. Total Synthesis of Indolizidine (-)-209I, Journal of Organic Chemicals, 70:7364-7370 (2005).
Agrawal, S. et al., Mixed-backbone oligonucleotides as second generation antisense oligonucleotides: In vitro and in vivo studies, Proc. Natl. Acad. Sci. USA, 94: 2620-2625 (1997).
Forster, A.C. and Symons, R.H. Self-cleavage of plus and minus RNAs of a virusoid and a structural model for the active sites, Cell, 49(2): 211-220 (1987).
Frazier, K.S. Antisense Oligonucleotide Therapies: The Promise and the Challenges from a Toxicologic Pathologist's Perspective, Toxicology Pathology, 43: 78-89 (2015).
Henry, S.P. et al., Activation of the Alternative Pathway of Complement by a Phosphorothioate Oligonucleotide: Potential Mechanism of Action, The Journal of Pharmacology and Experimental Therapeutics, 281(2): 810-816 (1997).
Isis Pharmaceuticals, Intellectual Property: Capturing Value From Innovation, Isis' Annual Meeting of Stockholders and Open House, Intellectual Property Poster, 1 page. (2011). Received from Internet <http://www.isispharm.com/Site_Gfx/pdf/11-AnMtg_IntellectualProperty_TAB.pdf>.
Isis Pharmaceuticals, Intellectual Property: Capturing Value From Innovation, Isis' Annual Meeting of Stockholders and Open House, Intellectual Property Poster, 1 page. (2012). Received from Internet <http://www.isispharm.com/Site_Gfx/pdf/2012_Annual_Meeting_IP_Poster.pdf>.

(56) References Cited

OTHER PUBLICATIONS

Wang, J.-C. et al., A stereoselective synthesis of dinucleotide phosphorothioate triesters through a chiral indol-oxazaphosphorine intermediate, Tetrahedron Letters, 38(5):705-708 (1997).
Boczkowska, M. et al., Stereodefined Phosphorothioate Analogues of DNA: Relative Thermodynamic Stability of the Model PS-DNA/DNA and PS-DNA/RNA complexes, Biochemistry, 41: 12483-12487 (2002).
Bumcrot, D et al., RNAi therapeutics: a potential new class of pharmaceutical drugs, Nat. Chem. Biol., 2: 711-9 (2006).
Crooke, S.T. and Geary, R.S. Clinical pharmacological properties of mipomersen (Kynamro), a second generation antisense inhibitor of apolipoprotein B, Br. J. Clin. Pharmacol., 76: 269-276 (2012).
Crooke, S.T., Molecular mechanisms of action of antisense drugs, Biochemica et Biophysica Acta, 1489: 31-44 (1999).
Deleavey, G.F. and Damha, M.J., Designing chemically modified oligonucleotides for targeted gene silencing. Chem. Biol., 19: 937-54 (2012).
Eckstein, F. et al., Stereochemistry of polymerization by DNA-dependent RNA-polymerase from *Escherichia coli*: an investigation with a diastereomeric ATP-analogue, Proc. Natl. Acad. Sci. USA, 73: 2987-90 (1976).
Hammond, S.M. and Wood, M.J. Genetic therapies for RNA mis-splicing diseases, Trends Genet., 27: 196-205 (2011).
Hartmann, B. et al., Sequence effects on energetic and structural properties of phosphorothioate DNA: a molecular modelling study, Nucleic Acids Research, 27(16): 3342-3347 (1999).
Hartmann, G. et al., Delineation of a CpG Phosphorothioate Oligodeoxynucleotide for Activating Primate Immune Responses In Vitro and In Vivo, The Journal of Immunology, 164(3): 1617-1624 (2000).
Heger, W. et al., Embryotoxic effects of thalidomide derivatives on the non-human primate Callithrix jacchus; 3. Teratogenic potency of the EM 12 enantiomers, Arch. Toxicol., 62: 205-208 (1988).
Jahns, H., et al., Stereochemical bias introduced during RNA synthesis modulates the activity of phosphorothioate siRNAs, Nat. Commun., 6: 6317 (2015).
Karwowski, B. et al., Stereocontrolled Synthesis of LNA Dinucleoside Phosphorothioate by the Oxathiaphospholane Approach, Bioorganic & Medicinal Chemistry Letters, 11: 1001-1003 (2001).
Koziolkiewicz, M., et al., Stereodifferentiation-the effect of P chirality of oligo(nucleoside phosphorothioates) on the activity of bacterial RNase H, Nucleic Acids Res., 23: 5000-5 (1995).
Kwon, H-J. et al., NF-kappaB-dependent regulation of tumor necrosis factor-alpha gene expression by CpG-oligodeoxynucleotides, Biochem. Biophys. Res. Commun., 311(1): 129-138 (2003).
Levin, A.A. et al., Basic Principles of the Pharmacokinetics of Antisense Oligonucleotide Drugs, Antisense Drug Technology: Principles, Strategies, and Applications, Second Edition, Chapter 7: 183-215 (2008).
Lima, W.F., et al., Human RNase H1 discriminates between subtle variations in the structure of the heteroduplex substrate, Mol. Pharmacol., 71: 83-91 (2007).
Linton, M.F., et al., Transgenic Mice Expressing High Plasma Concentrations of Human Apolipoproteins B100 and Lipoprotein (a), J. Clin. Invest., 92: 3029-37 (1993).
Meade, M.F., et al., Efficient delivery of RNAi prodrugs containing reversible charge-neutralizing phosphotriester backbone modifications, Nat. Biotech., 32: 1256-61 (2014).
Nielsen, J. and Caruthers, M.H., Directed Arbuzov-type reactions of 2-cyano-1,1-dimethylethyl deoxynucleoside phosphites, J. Am. Chem. Soc., 110: 6275-6 (1988).
Sharma, V.K. et al. Antisense oligonucleotides: modifications and clinical trials, Med. Chem. Commun., 5: 1454-71 (2014).
Swayze, E.E. and Bhat, B., The medicinal chemistry of oligonucleotides, Crooke, S.T. (ed) Antisense Drug Technology: Principles, Strategies, and Applications, CRC Press, Boca Raton, FL: 143-82 (2007).
Swayze, E.E. et al., Antisense oligonucleotides containing locked nucleic acid improve potency but cause significant hepatotoxicity in animals, Nucleic Acids Research, 35(20: 687-700 (2007).
U.S. Food and Drug Administration, Development of New Stereoisomeric Drugs, 8 pages (May 1, 1992). URL: http://www.fda.gov/Drugs/GuidanceComplianceRegulatoryInformation/Guidances/ucm122883.htm [Retrieved Jun. 15, 2016].
WaVe Life Sciences Poster, Therapeutic Implications of Controlling P-Chirality in Phosphorothioate Oligonucleotides, TIDES, San Diego (May 3-6, 2014).
Yu, D. et al., Stereo-Enriched Phosphorothioate Oligodeoxynucleotides: Synthesis, Biophysical and Biological Properties, Bioorganic & Medicinal Chemitry, 8: 275-284 (2000).
Yu, D., et al., Stereo-enriched phosphorothioate oligodeoxynucleotides: synthesis, biophysical and biological properties. Bioorg. Med. Chem. 8: 275-84 (2000).
Yu, R.Z. et al., Cross-species comparison of in vivo PK/PD relationships for second-generation antisense oligonucleotides targeting apolipoprotein B-100, Biochem. Pharmacol., 77: 910-919 (2009).
Adams, S.P. et al., Hindered dialkylamino nucleoside phosphite reagents in the synthesis of two DNA 51-mers, Journal of the American Chemical Society, 105(3): 661-663 (1983).
Adarsh, et al., Organelle Specific Targeted Drug Delivery—A Review, International Journal of Research in Pharmaceutical and Biomedical Sciences, 2(3): 895-912 (2011).
Agrawal, S. and Tang, J.Y., Gem 91—an antisense oligonucleotide phosphorothioate as a therapeutic agent for AIDS, Antisense Research and Development, 2(4):261-266 (1992).
Aldaye, F.A. et al., Assembling materials with DNA as the guide, Science, 321(5897): 1795-1799 (2008).
Almer et al., Synthesis of Stereochemically Homogeneous Oligoribonucleoside All-Rp-Phosphorothioates by Combining H-Phosphonate Chemistry and Enzymatic Digestion, J. Chem. Soc., Chem. Commun., 1459-1460 (1994).
Almer, et al. A New Approach to Stereospecific Synthesis of P-chiral Phosphorothioates. Preparation of Diastereomeric Dithymidyl-(3'-5') Phosphorothioates, Chem. Commun., (3): 290-1 (2004).
Almer, et al. Solid Support Synthesis of all-Rp-oligo(ribonucleoside phosphorothioate)s, Nucleic Acids Res., 24(19): 3811-3820 (1996).
Almer, H. et al., Synthesis of Diribonucleoside Phosphorothioates via Sterospecific Sulfurization of H-Phosphonate Diesters, J. Org. Chem., 57(23): 6163-6169 (1992).
Altschul, S.F. et al., Basic local alignment search tool, Journal of Molecular Biology, 215(3):403-410 (1990).
Altschul, S.F. et al., Gapped BLAST and PSI-BLAST: a new generation of protein database search programs, Nucleic Acids Research, 25(17):3389-3402 (1997).
Alul, R.H. et al., Oxalyl-Cpg: a labile support for synthesis of sensitive oligonucleotide, Nucleic Acids Research, 19(7):1527-1532 (1991).
Alvarez, K. et al., Photocleavable Protecting Groups as Nucleobase Protections Allowed the Solid-Phase Synthesis of Base-Sensitive SATE-Prooligonucleotides, Journal of Organic Chemistry, 64(17): 6319-6328(1999).
Aristarkhova, L.N. et al., Investigation in the field of thiosulfonic acids. 28. alkyl esters of cyclopentane—and cyclohexanethiosulfonic acids, Journal of Organic Chemistry of the USSR, 6: 2454-2458 (1970).
Athyros, V.G. et al., Antisense technology for the prevention or the treatment of cardiovascular disease: the next blockbuster?, Expert Opin. Investig. Drugs, 17(7): 969-72 (2008).
Ausin, C. et al., Assesment of heat-sensitive thiophosphate protecting groups in the development of thermolytic DNA oligonucleotide prodrugs, Tetrahedron, 66(1):68-79 (2010).
Bachelin et al., Structure of a Stereoregular Phosphorothioate DNA/RNA duplex, Nat. Struct. Biol., 5(4): 271-276 (1998).
Baek, M-S. et al., In Vitro Metabolic Stabilities and Metabolism of 2'-O-(Methoxyethyl) Partially Modified Phosphorothioate Antisense Oligonucleotides in Preincubated Rat or Human Whole Liver Homogenates, Oligonucleotides, 20(6): 309-316 (2010).

(56) References Cited

OTHER PUBLICATIONS

Ballas, Z.K. et al., Induction of NK Activity in Murine and Human Cells by CpG Motifs in Oligodeoxynucleotides and Bacterial DNA, J. Immunoll., 57: 1840-1845 (1996).

Barber, I. et al., The Prooligonucleotides Approach I: Esterase-Mediated Reversibility of Dithymidine S-Alkyl Phosphorothiolates to Dithymidine Phosphorothioates, Bioorganic and Medicinal Chemistry Letters, 5(6):563-568 (1995).

Barber, I. et al., The Prooligonucleotides Approach II: Synthesis and stability studies of chimeric oligonucleotide models, Bioorganic and Medicinal Chemistry Letters, 5(14):1441-1444 (1995).

Barnes, P.J. and Peterson, S. Efficacy and Safety of Inhaled Corticosteroids in Asthma, Am. Rev. Respir. Dis., 148: SI-S26 (1993).

Battistini et al., Stereoselective Synthesis of Cyclic Dinucloetide Phosphorothioates, Tetrahedron, 49(5): 1115-1132 (1993).

Bayever, E. et al., Systematic administration of a phosphorothioate oligonucleotide with a sequence complementary to p53 for acute myelogenous leukemia and myelodysplastic syndrome: intial results of a phase I trial, Antisense Research Development, 3(4):383-390 (1993).

Beal, P.A. et al., Second Structural Motif for Recognition of DNA by Oligonucleotide-Directed Triple-Helix Formation, Science, 251: 1360-1363 (1991).

Beaucage, S.L. and Iyer, R.P., Advances in the Synthesis of Oligonucleotides by the Phosphoramidite Approach, Tetrahedron, 48(12): 2223-2311 (1992).

Benner, S.A. and Sismour, A.M., Synthetic biology, Nature Reviews Genetics, 6(7):533-543 (2005).

Berge, S.M. et al., Pharmaceutical salts, J. Pharm. Sci., 66(1):1-19 (1997).

Besch, R. et al, Specific Inhibition of ICAM-1 Expression Mediated by Gene Targeting with Triplex-forming Oligonucleotides, J. Biol. Chem., 277(26): 32473-32479 (2002).

Bisbal, C. and Silverman, R.H., Diverse functions of RNase L and implication in pathology, Biochimie, 89(6-7):789-798 (2007).

Block, E. et al., Allium Chemistry: Synthesis and Sigmatropic Rearrangements of Alk(en)yl 1-Propenyl Disulfide S-Oxides from Cut Onion and Garlic, Journal of the Ameican Chemical Society, 118(12): 2799-2810 (1996).

Bock, L.C. et al., Selections of single-stranded DNA molecules that bind and inhibit human thrombin, Nature, 355: 564-566 (1992).

Bode, C. et al. CpG DNA as a vaccine adjuvant, Expert Rev. Vaccines, 10(4): 499-511 (2011).

Bodor, N. et al., A convenient synthesis of (acyloxy)alkyl .alpha.-ethers of phenols, The Journal of Organic Chemistry, 48(26):5280-5284 (1983).

Bohringer, M. et al., Why Pentose and not Hexose Nucleic Acids? Part II: Oligonucleotides of 2'3'-dideoxy-β-d-glucopyranosyl ('homo-DNA') production, Helvetica Chimica Acta, 75:1416-1477 (1992).

Bologna, J. et al., Uptake and Quantification of Intracellular Concentration of Lipophilic Pro-Oligonucleotides in HeLa Cells, Antisense and Nucleic Acid Drug Development, 12(1):33-41 (2002).

Boudreau, R.L. et al., Nonallele-specific silencing of mutant and wild-type huntingtin demonstrates therapeutic efficacy in Huntington's disease mice, 17(6): 1053-1063 (2009).

Brill, W. et al., Thioalkylation of Nucleoside-H-Phosphonates and Its Application to Solid Phase Synthesis of Oligonucleotides, Tetrahedron Letters, 36(5):703-706 (1995).

Brooks, P.C. et al., Insulin-like Growth Factor Receptor Cooperates with Integrin αvβ5 to Promote Tumor Cell Dissemination in Vivo, The Journal of Clinical Investigation, 99(6):1390-1398 (1997).

Brown, J.W.S. and Simpson, C.G., Splice Site Selection in Plant Pre-mRNA Splicing, Ann. Rev. Plant Physiol. Plant Mol. Biol., 49: 77-95 (1998).

Bundgaard, H., (C) Means to Enhance Penetration. (1) Prodrugs as a means to improve the delivery of peptide drugs, Advanced Drug Delivery Reviews, 8:1-38 (1992).

Bundgaard, H., Design and Application of Prodrugs, A Textbook of Drug Design and Development, Edited by Krogsgaard-Larsen, P. and Bundgaard, H., Chapter 5: 113-191 (1991).

Bundgaard, H., Design of Prodrugs, Elsevier, 7-9 and 21-24 (Chapter 1) (1985).

Bunnell. B.A. et al., Targeted Delivery of Antisense Oligonucleotides by Molecular Conjugates, Somatic Cell and Molecular Genetics, 18(6):559-569 (1992).

Carbone, G.M. et al., Selective inhibition of transcription of the Ets2 gene in prostate cancer cells by a triplex-forming oligonucleotide, Nucl. Acid. Res., 31: 833-843 (2003).

Carrillo, H., and Lipman, D.J., The multiple sequence alignment problem in biology, SIAM J. Appl. Math., 48:1073-1082 (1988).

Chatgilialoglu, C. and Snieckus, V., Chemical Synthesis: Gnosis to Prognosis, Kluwer Academic, 293-340 (1996).

Check, E., RNA interference: hitting the on switch, Nature, 448(7156): 855-858 (2007).

Chiu, Y. and Rana, T.M., siRNA function in RNAi: A chemical modification analysis, RNA, 9(9):1034-1048 (2003).

Cieslak, J. et al., Thermolytic 4-methylthio-1-butyl group for phosphate/thiophosphate protection in solid-phase synthesis of DNA oligonucleotides, Journal of Organic Chemistry, 69(7):2509-2515 (2004).

Conway, N., The introduction of reporter groups at multiple and/or specific sites in DNA containing phosphorothioate diesters, Nucleic Acids Research, 43-44 (1989).

Cooney, M., et al., Site-Specific Oligonucleotide Binding Represses Transcription of the Human c-myc Gene in Vitro, Science, 241: 456-459 (1988).

Cosstick, R. and Eckstein, F., Synthesis of d(GC) and d(CG) Octamers Containing Alternating Phosphorothioate Linkages: Effect of the Phosphorothioate Group on the B-Z Transition, Biochemistry, 24: 3630-3638 (1985).

Coughlin, J.E. et al., Orally bioavailable anti-HBV dinucleotide acyloxyalkyl prodrugs, Bioorganic and Medicinal Chemistry Letters, 20(5):1783-1786 (2010).

Cox, J.R. and Ramsay, O.B., Mechanisms of Nucleophilic Substitution in Phosphate Esters, Chemical Reviews, 64(4): 317-352, (1964).

Crary, S.M. et al., Specific phosphorothioate substitutions probe the active site of Bacilus subtilis ribonuclease P, RNA, 8:933-947 (2002).

Cullen, K.A. et al., Ambulatory surgery in the United States, 2006, National Health Statistics Reports, 11: 1-28 (Jan. 28, 2009-Revised Sep. 4, 2009).

Current Protocols in Nucleic Acid Chemistry, Edited by Beaucage, S.L. et al., Chapter 2: Protection of Nucleosides for Oligonucleotide Synthesis, 2.0.1.-2.16.31 (2012).

Davis, B.G. et al., Altering the specificity of subtilisin Bacillus lentus through the introduction of positive charge at single amino acid sites, Bioorganic & Medicinal Chemistry, 7(11): 2303-2311 (1999).

Devereux, J. et al., A comprehensive set of sequence analysis programs for the VAX, Nucleic Acids Research, 12(1):387-395 (1984).

Dietz, G.P.H. et al., Delivery of bioactive molecules into the cell: the Trojan horse approach, Molecular and Cellular Neuroscience, 27(2): 85-131 (2004).

Djukanovic, R. et al., Mucosal Inflammation in Asthma, Am. Rev. Respir. Dis., 142: 434-457 (1990).

Dorman et al., Synthesis of Oligodeoxynucleotides and Oligodeoxynucleotide Analogs using Phosphoramidite Intermediates, Tetrahedron, 40(1):95-102 (1984).

Dua, P. et al., Patents on SELEX and therapeutic aptamers, Recent Patents on DNA & Gene Sequences, 2(3):172-186 (2008).

Eaton, W.A. et al., Submillisecond kinetics of protein folding, Curr. Opin. Chem. Biol., 1:10-14 (1997).

Eckstein, F. Phosphorothioates, Essential Components of Therapeutic Oligonucleotides, Nucleic Acid Therapeutics, 1-14 (2014).

Eckstein, F., Oligonucleotides and Analogues a Practical Approach, IRL Press, 1-24 (1991).

(56) References Cited

OTHER PUBLICATIONS

Egli, M. et al., Crystal structure of homo-DNA and nature's choice of pentose over hexose in the genetic system, Journal of the American Chemical Society, 128(33):10847-56 (2006).
El Harchaoui, K. et al., Current and future pharmacologic options for the management of patients unable to achieve low-density lipoprotein-cholesterol goals with statins, Am. J. Cardiovasc. Drugs, 8(4): 233-242 (2008).
Elbashir, S.M. et al., Duplexes of 21-nucleotide RNAs mediate RNA interference in cultured mammalian cells, Nature, 411: 494-498 (2001).
Elbashir, S.M. et al., Functional anatomy of siRNAs for mediating efficient RNAi in *Drosophila melanogaster* embryo lysate, The EMBO Journal, 20(23): 6877-6888 (2001).
Ellington, A.D. and Szostak, J.W., In vitro selection of RNA molecules that bind specific ligands, Nature, 346: 818-822 (1990).
Epton, R., Innovation and Perspectives in Solid Phase Synthesis, Peptides, Proteins and Nucleic Acids, 21:157-162 (1994).
Eschenmoser, A. et al., Why pentose—and not hexose-nucleic acids? Introduction to the problem, conformational analysis of oligonucleotide single strands containing 2', 3'-dideoxyglucopyranosyl building blocks ('homo-DNA'), and reflections on the conformation of A-and B-DNA, Helvetica Chimica Acta, 75:218-259 (1992).
Eschenmoser, A., Chemical etiology of nucleic acid structure, Science, 284(5423):2118-24 (1999).
Eschenmoser, A., Towards a Chemical Etiology of the Natural Nucleic Acids' Structure, Chemical Synthesis, Edited by Chatgilialoglu, C. and Sniechus, V., Kluwer Academic Publishers, 293-340 (1996).
Famulok, M. Oligonucleotide aptamers that recognize small molecules, Curr. Opin. Struct. Biol., 9: 324-329 (1999).
Fendrich et al., Determination of the Absolute P-configuration of a Phthalidyl Phosphonate Thymidine-Thymidine Dimer, Nucleosides Nucleotides Nucleic Acids., 22(5-8): 1127-1129 (2003).
Ferreira, F. et al., Lewis acid deprotection of silyl-protected oligonucleotides and base-sensitive oligonucleotide analogues, Tetrahedron Letters, 45(33):6287-6290 (2004).
Fire, A. et al., Potent and specific RNA interference by double-stranded RNA in Caenorhadbditis elegans, Nature, 391: 806-811 (1998).
Forster, A.C. and Symons, R.H. Self-Cleavage of Virusoid RNA is performed by the Proposed 55-Nucleotide Active Site, Cell, 49(2): 211-20 (1987).
Frank-Kamenetsky, M. et al., Therapeutic RNAi targeting PCSK9 acutely lowers plasma cholesterol in rodents and LDL cholesterol in nonhuman primates. Proc. Natl. Acad. Sci. USA., 105(33): 11915-11920 (2008).
Frederiksen, J.K. et al., Separation of RNA Phosphorothioate Oligonucleotides by HPLC, Methods of Enzymology, 468:289-309 (2009).
Freier, S.M. et al., Improved free-energy parameters for predictions of RNA duplex stability, Proc. Nat. Acad. Sci. USA, 83: 9373-9377 (1986).
Froehler, B.C. et al., Synthesis of DNA via deoxynucleoside H-phosphonate intermediates, Nucleic Acids Research, 14(13): 5399-5407 (1986).
Fujii et al., Acylphosphonates. 5.1A new method for stereospecific generation of phosphorothioate via aroylphosphonate intermediate, Tetrahedron Letters, 27(8): 935-938 (1986).
Fujii et al., Acylphosphonates. 7.1 A New Method for Stereospecific and Stereoselective Generation of Dideoxyribonucleoside Phosphorothioates via the Acylphosphonate Intermediates, Tetrahedron, 43: 3395-3407 (1987).
Garegg, P.J. et al., Nucleoside H-Phosphonates. III. Chemical Synthesis of Oligodeoxyribonucleotides by the Hydrogenphosphonate Approach, Tetrahedron Letters, 27(34): 4051-4054 (1986).

Gauglitz, G.G. et al., Hypertrophic Scarring and Keloids: Pathomechanisms and Current Emerging Treatment Strategies, Mol. Med., 17(1-2): 113-125 (2011).
Goraczniak, R. et al., Gene silencing by synthetic U1 Adaptors, Nature Biotechnology 27(3): 257-263 (2008).
Gosselin, G. et al., New insights regarding the potential of the pronucleotide approach in antiviral chemotherapy, 43(1):195-208 (1996).
Gough, G.R. et al., Recovery and recycling of synthetic units in the construction of oligodeoxyribonucleotides on solid supports, Tetrahedron Letters, 22(42): 4177-4180 (1981).
Graham, M.J. et al., Antisense inhibition of proprotein convertase subtilisin/kexin type 9 reduces serum LDL in hyperlipidemic mice, J. Lipid Res., 48(4): 763-767 (2007).
Grajkowski, A. et al., Design and Development of Thermolytic DNA Oligonucleotide Prodrugs, Annals of the New York Academy of Sciences, 1058:26-38 (2005).
Grajkowski, A. et al., Solid-Phase Synthesis of Thermolytic DNA Oligonucleotides Functionalized with a Single 4-Hydroxy-1-butyl or 4-Phosphato-/Thiophosphato-1-butyl Thiophosphate Protecting Group, Journal of Organic Chemistry, 72(3): 805-815 (2007).
Grajkowski, A. et al., Thermolytic CpG-containing DNA oligonucleotides as potential immunotherapeutic prodrugs, Nucleic Acids Research, 33(11):3550-3560 (2005).
Green, L.S. et al., Inhibitory DNA Ligands to Platelet-Derived Growth Factor B-Chain, Biochemistry, 35: 14413-14424 (1996).
Green, L.S. et al., Nuclease-resistant nucleic acid ligands to vascular permeability factor/vascular endothelial growth factor, Chem. Biol., 2(10): 683-695 (1995).
Griffiths-Jones, S. et al., miRBase: microRlVA sequences, targets and gene nomenclature, Nucleic Acids Research, 34 (Database Issue): D140-D144 (2006).
Griffiths-Jones, S. The microRNA Registry, Nucleic Acids Research, 32 (Database Issue): D109-D111 (2004).
Groebke, K. et al., Why pentose and not hexose nucleic acids? Part V. Purine-purine pairing in homo-DNA: guanine, isoguanine, 2,6-diaminopurine and xanthine. Helvetica Chimica Acta. 81: 375-474 (1998).
Gude, L. et al., Mapping Targetable Sites on Human Telomerase RNA Pseudoknot/Template Domain Using 2'-OMe RNA-interacting Polynucleotide (RIPtide) Microarrays, J. Biol. Chem., 287(22): 18843-18853 (2012).
Guerlavais-Dagland, T et al., Fluoride-labile protecting groups for the synthesis of base-sensitive methyl-SATE oligonucleotide prodrugs, European Journal of Organic Chemistry, 2003(12): 2327-2335 (2003).
Guga et al., Oxathiaphospholane Approach to the Synthesis of P-Chiral, Isotopomeric Deoxy(ribonucleoside phosphorothioate)s and Phosphates Labeled with an Oxygen Isotope. Angew Chem., 113(3): 630-633 (2001).
Guga et al., Unusual Thermal Stability of RNA/[RP-PS]-DNA/RNA Triplexes Containing a Homopurine DNA Strand, Biophys J., 92(7): 2507-2515 (2007).
Guga, P., P-chiral oligonucleotides in biological recognition processes, Current Topics in Medicinal Chemistry, 7:695-713 (2007).
Guzaev, A.P., Reactivity of 3H-1,2,4-dithiazole-3-thiones and 3H-1,2-dithiole-3-thiones as sulfurizing agents for oligonucleotide synthesis, Tetrahedron Letters, 52: 434-437 (2011).
Hacia, J.G. et al., Phosphorothioate oligonucleotide-directed triple helix formation, Biochemistry, 33:5367-5369 (1994).
Hanagata, N., Structure-dependent immunostimulatory effect of CpG oligodeoxynucleoties and their delivery system, Int. J. Nanomedicine, 7: 2181-95 (2012).
Harper, S.Q. et al., RNA interference improves motor and neuropathological abnormalities in a Huntington's disease mouse model, Proc. Natl. Acad. Sci. USA, 102(16): 5820-5825 (2005).
Hau, P. et al., Results of 0004, a phase lib actively controlled clinical trial with the TGF-b2 targeted compound AP 12009 for recurrent anaplastic astrocytoma, Journal of Clinical Oncology, 2006 ASCO Annual Meeting Proceedings (Post-Meeting Edition), 24(Jun. 20, 2018 Supplement): 1566 (2006).
Hayashi, S. et al., Studies on Antitumor Substances, Chemical & Pharmaceutical Bulletin, 12(11): 1271-1276 (1964).

(56) References Cited

OTHER PUBLICATIONS

Henry, A.A. and Romesberg, F.E., Beyond A, C, G and T: augmenting nature's alphabet, Current Opinion in Chemical Biology, 7(6): 727-733 (2003).
Herbert, B-S. et al., Nonradioactive detection of telomerase activity using the telomeric repeat amplification protocol, Nat. Protoc., 1(3): 1583-1590 (2006).
Herdewijn, Oligonucleotide Synthesis, Methods in Molecular Biology, 288: 1-435 (2005).
Heuberger, B.D. and Switzer, C., A Pre-RNA Candidate Revisited: Both Enantiomers of Flexible Nucleoside Triphosphates are DNA Polymerase Substrates, Journal of the American Chemical Society, 130(2):412-413 (2008).
Higuchi, T. et al., Pro-drugs as Novel Delivery Systems, ACS Symposium Series, 14 (1975).
Hirao, I., Unnatural base pair systems for DNA/RNA-based biotechnology, Current Opinion in Chemical Biology,10:622-627 (2006).
Hohjoh, H., Disease-Causing Allele-Specific Silencing by RNA Interference, Pharmaceuticals, 6: 522-535 (2013).
Hunziker, J. et al., Why Pentose-And Not Hexose-Nucleic Acids? Part III. Oligo(2',3'-dideoxy-β-D-glucopyranosyl)nucleotides. ('Homo-DNA'): Base-Pairing Properties, Helvetica Chimica Acta, 76(1):259-352 (1993).
International Search Report for PCT/IB2009/007923, 4 pages dated (Sep. 6, 2010).
International Search Report for PCT/US2010/041068, 1 page dated (Sep. 1, 2010).
International Search Report for PCT/US2011/064287, 2 pages dated (Apr. 12, 2012).
International Search Report for PCT/US2012/046805, 2 pages dated (Sep. 19, 2012).
International Search Report for PCT/US2013/050407, 5 pages dated (Jan. 9, 2014).
Iwamoto et al., Stereocontrolled Synthesis of H-phosphonate DNA, Nucleic Acids Symposium Series, (50):159-60 (2006).
Iwamoto, N. et al., Stereocontrolled solid-phase synthesis of oligonucleoside H-phosphonates by an oxazaphospholidine approach, Angewandte Chemie International Edition, 48(3):496-499 (2009).
Iyer, R.P. et al., A novel nucleoside phosphoramidite synthon derived from 1R, 2S-ephedrine, Tetrahedron Asymmetry 6(5):1051-1054 (1995).
Iyer, R.P. et al., Acyloxyaryl prodrugs of oligonucleoside phosphorothioates, Bioorganic and Medicinal Chemistry Letters, 6(16):1917-1922 (1996).
Iyer, R.P. et al., Bioreversible oligonucleotide conjugates by site-specific derivatization, Bioorganic and Medicinal Chemistry Letters, 7:871-876 (1997).
Iyer, R.P. et al., Stereospecific Bio-Reversibility of Dinucleoside S-Alkyl Phosphorothiolates to Dinucleoside Phosphorothioates, Bioorganic & Medicinal Chemistry Letter, 4(20):2471-2476 (1994).
Iyer, R.P., et al., 3H-1,2-Benzodithiole-3-one 1,1-Dioxide as an Improved Sulfurizing Reagent in the Solid-Phase Synthesis of Oligodeoxyribonucleoside Phosphorothioates, Journal of the American Chemical Society, 112(3):1253-1254 (1990).
Iyer, R.P., et al., Prodrugs of Oligonucletides:The Acyloxyalkyl Esters of Oligodeoxyribonucleoside Phosphorothioates, Bioorganic Chemistry, 23:1-21 (1995).
Iyer, R.P., et al., Solid-phase stereoselective synthesis of oligonucleoside phosphorothioates: The nucleoside bicyclic oxazaphospholidines as novel synthons, Tetrahedron Letters, 39:2491-2494 (1998).
Jiang, J. et al., Allele-Specific Silencing of Mutant Myh6 Transcripts in Mice Suppresses Hypertrophic Cardiomyopathy, Science, 342: 111-114 (2013).
Jin et al., A Stereoselective Synthesis of Dinucleotide Boranophosphate, Using Chiral Indole-Oxazaphosphorine Intermediates, Tetrahedron Letters, 39: 6433-6436 (1998).

Jin et al., Stereoselective Synthesis of Dithymidine Phosphorothioates Using Xylose Derivatives as Chiral Auxiliaries, J. Org. Chem., 63(11): 3647-3654 (1998).
Johansson et al., Studies towards synthesis of dinucleoside arylphosphonates with metal complexing properties, Nucleosides Nucleotides & Nucleic Acids, 22(5-8): 1459-61 (2003).
Johansson et al., Synthesis of dinucleoside pyridylphosphonates involving palladium(o)-catalysed phosphorus-carbon bond formation as a key step, Chem. Commun., 2564-2565 (2001).
Johansson et al., The case for configurational stability of H-phosphonate diesters in the presence of diazabicyclo[5.4.0]undec-7-ene (DBU), Bioorg Med Chem., 9(9): 2315-22 (2001).
Jopling, C.L. et al., Modulation of Hepatitis C Vicus RNA Abundance by a Liver-Specific MicroRNA, Science, 309: 1577-1581 (2005).
Joyce, G.F. et al., The case for an ancestral genetic system involving simple analogues of the nucleotide, Proceedings of the National Academy of Sciences, 84:4398-4402 (1987).
Joyce, G.F. The antiquity of RNA-based evolution, Nature, 418(6894): 214-221 (2002).
Kakeya, N. et al., Studies on Prodrugs of Cephalosporins. I. Synthesis and Biological Properties of Glycyloxybenzoyloxymethyl and Glycylaminobenzoyloxymethyl Esters of 7 -[2-(2-Aminothiazol-4-yl)-(Z)-2-methoxyiminoacetamido]-3-methyl-3-cephem-4-carboxylic Acid, Chem. Pharm. Bull., 32(2): 692-698 (1984).
Kamada, A.K. et al., Issues in the Use of Inhaled Glucocorticoids, Am. J. Respir. Crit. Care. Med., 153: 1739-1748 (1996).
Kawasaki, A et. al., Uniformly Modified 2'-Deoxy-2'-fluoro Phosphorothioate Oligonucleotides as Nuclease-Resistant Antisense Compounds with High Affinity and Specificity for RNA Targets, J. Med. Chem., 36: 831-841 (1993).
Kers et al., A new type of nucleotide analogue with 4-pyridylphosphonate internucleotide linkage, Tetrahedron Letters, 40(22): 4263-4266 (1999).
Kim, N.W. et al., Specific Association of Human Telomerase Activity with Immortal Cells and Cancer, Science, 226: 2011-2015 (1994).
Kim, S-H. and Cech, T.R., Three-dimensional model of the active site of the selfsplicing rRNA precursor of Tetrahymena, Proc. Natl. Acad. Sci. U S A., 84(24): 8788-8792 (1987).
Klose, J. et al., Preparation of 2-(2-Cyanoethyl)-sulfany1-1H-isoindole-1,3-(2H)-dione and related sulfur transfer reagents, Tetrahedron, 53(42):14411-14416 (1997).
Kool, E.T., Replacing the Nucleobases in DNA with Designer Molecules, Accounts of Chemical Research, 35:936-943 (2002).
Kordasiewicz, H.B. et al., Sustained therapeutic reversal of Huntington's disease by transient repression of huntingtin synthesis, Neuron, 74(6): 1031-1044 (2012).
Kozikowski, A.P. et al., Chemistry of the main group metals: A stereoselective synthesis of allyl vinyl thioethers for the thio-claisen reaction, Journal of Organometallic Chemistry, 164(3): C33-C37 (1979).
Koziolkewicz et al., Stability of Stereoregular Oligo-(nucleoside Phosphorothioate)s in Human Plasma: Diastereoselectiviy of Plasma 3'-Exonuclease, Antisense Nucl. Acid Drug Dev., 7: 43-48 (1997).
Koziolkewicz et al., Stereodifferentiation-the effect of P chirality of oligo(nucleoside phosphorothioates) on the activity of bacterial RNase H, Nucl. Acids Res., 23(24): 5000-5005 (1995).
Kraszewski et al., Studies on Reactions of Nucleoside H-phosphonates with Bifunctional Reagents. Part 1. Reaction with amino alcohols, J. Chem. Soc., Perkin Trans., 1: 1699-1704 (1993).
Krieg, A.M. et al., CpG motifs in bacterial DNA trigger direct B-cell activation, Nature, 374: 546-549 (1995).
Krieg, A.M. et al., P-Chirality-Dependent Immune Activiation by Phosphorothioate CpG Oligodeoxynucleotides, Oligonucleotides, 13:491-499 (2003).
Krueger, A.T. et al., Synthesis and properties of size-expanded DNAs: toward designed, functional genetic systems, Accounts of Chemical Research, 40:141-150 (2007).
Krutzfeldt, J. et al., Silencing of microRNAs in vivo with 'antagomirs', Nature, 438: 685-689 (2005).

(56) References Cited

OTHER PUBLICATIONS

LaPlanche, L.A. et al., Phosphorothioate-modified oligodeoxyribonucleotides. III. NMR and UV spectroscopic studies of the Rp-Rp, Sp-Sp, and Rp.Sp duplexes, [d(GGsAATI'CC)2, derived from diastereomeric 0-ethyl phosphorothioates, Nucleic Acids Research, 14(22): 9081-9093 (1986).
Latimer, L.J.P. et al, Synthetic repeating sequence DNAs containing phosphorothioates: nuclease sensitivity and triplex formation, Nucleic Acids Research, 17(4): 1549-1561 (1989).
Laurent et al., Chiral and steric effects in the efficient binding of alpha-anomeric deoxyoligonucleoside N-alkylphosphoramidates to ssDNA and RNA, Nucleic Acids Res., 27(21): 4151-9 (1999).
Lavergne, T. et al., A Base-Labile Group for 2'-OH Protection of Ribonucleosides: A Major Challenge for RNA Synthesis, Chem. Eur. J, 14, 9135-9138 (2008).
Lesnikowski et al., Studies on Stereospecific Formation of P-Chiral Internucleotide Linkage. Synthesis of (RP, RP)—and (SP, SP)—Thymidylyl (3', 5') Thymidylyl (3', 5') Thymidine DI (O,O-Phosphorothioate) Using 2-Nitrobenzyl Group as a New S-Protection, Tetrahedron Letters 30(29) 3821-3824 (1989).
Lesnikowski, Z. J. et al., Octa(thymidine methanephosphonates) of partially defined sterochemistry: synthesis and effect of chirality at phosphorus on binding to pentadecadeoxyriboadenylic acid, Nucleic Acids Research, 18(8): 2109-2115 (1990).
Li L.C., Small RNA Mediated Gene Activation, RNA and the Regulation of Gene Expression: A Hidden Layer of Complexity, Edited by Kevin V. Morris, Chapter 13, Caister Academic Press (2008).
Li, L-C. et al., Small dsRNAs induce transcriptional activation in human cells, PNAS, 103(46): 17337-17342 (2006).
Li-Tsang, C.W. et al., Prevalence of hypertrophic scar formation and its characteristics among the Chinese population, Burns, 31: 610-616 (2005).
Lima, W. et al., Single-Stranded ssRNAi Activate RNAi in Animals, Cell, 150: 883-894 (2012).
Lima, W.F. et al., The influence of antisense oligonucleotide-induced RNA structure on *Escherichia coli* RNase H1 activity, J. Biol. Chem., 272(29):18191-9 (1997).
Limbach, P.A. et al., Summary: the modified nucleosides of RNA, Nucleic Acids Research, 22(12):2183-2196 (1994).
Lin et al., Synthesis and resolution of dinucleotide (TpAZT) phosphoramidates, Synthetic Commun., 33(14): 2553-2562 (2003).
Lu, X. et al., Antisense-Mediated Inhibition of Human Immunodeficiency Virus (HIV) Replication by Use of an HIV Type 1-Based Vector Results in Severely Attenuated Mutants Incapable of Developing Resistance, Journal of Virology, 78(13): 7079-7088 (2004).
Lu, Y. and Just, G., Stereoselective synthesis of dithymidine phosphorothioates using d-xylose derived chiral auxiliaries, Tetrahedron, 57(9):1677-1687 (2001).
Lu, Y. et al., Stereoselective Synthesis of R(P)—and S(P)-Dithymidine Phosphorothioates via Chiral Indolooxazaphosphorine Intermediates Derived from Tryptophan This work was financially supported by Natural Science and Engineering Research Council of Canada (NSERC). We thank Nadim Saadeh and Dr. Orval Mamer, McGill University biomedical mass spectroscopy unit, for recording mass spectra, Angewandte Chemie International Edition, 39(24):4521-4524 (2000).
Machytka et al., Extension of the Applicability of &I-Values for the Configurational Assignment of Diastereomeric Phosphate-Modified Dideoxynucleotides, Nucleosides and Nucleotides, 17(12): 2311-2322 (1998).
Machytka et al., Synthesis and NMR characterization of diastereomeric CPSMeG derivatives, Nucleosides Nucleotides Nucleic Acids., 19(5-6): 903-15 (2000).
Maher III, L.J., et al., Inhibition of DNA Binding Proteins by Oligonucleotide-Directed Triple Helix Formation, Science, 245: 725-730 (1989).
Mann, M.J. et al., Therapeutic applications of transcription factor decoy oligonucleotides, J. Clin. Invest., 106:1071-1075 (2000).

Mannironi, C. et al., In Vivo Selection of Dopamine RNA Ligands, Biochemistry, 36: 9726-9734 (1997).
Martin, P., A New Access to 2'-O-alkylated Ribonucleosides and Properties of 2'-O-Alkylated Oligoribonucleotides, Helv. Chim. Acta., Abstract Only, 78: 486-504 (1995).
Martin, P., Stereoselective Synthesis of 2'-O-(2-Methoxyethyl)ribonucleosides: Neighboring-Group Participation of the Methoxyethoxy Group in the Ribosylation Step, Helv. Chim. Acta, Abstract Only, 79: 1930-1938 (1996).
Masahiro, T. et al., Nematicidal and antimicrobial constituents from *Allium grayi* Regel and *Allium fistulosum* L. var. caespitosum, Agricultural and Biological Chemistry, 52(9): 2383-2385 (1988).
Maung, J. et al., Alternatives to 1-H-tetrazole in the preparation of phosphonate diesters and phosphonamidates from phosphonyl dichlorides, Tetrahedron Lett., 45: 6497-6499 (2004).
Mauritz, R.P. et al., Elucidation of the Hydrolytical Properties of α-Hydroxybenzylphosphonates as a New Potential Pro-Oligonucleotide Concept, Nucleosides and Nucleotides, 18(6-7):1417-1418 (1999).
Mauritz, R.P. et al., Synthesis of 3',5'-Dithymidylyl-α-hydroxyphosphonate Dimer Building Blocks for Oligonucleotide Synthesis—A New Pro-oliguncleotide, Nucleosides and Nucleotides, 16(7-9):1209-1212 (1997).
McBride, J.L. et al., Prelinical Safety of RNAi-Mediated HTT Suppression in the Rhesus Macaque as a Potential Therapy for Huntington's Disease, Molecular Therapy, 19: 1-11 (2011).
Medical News Today, AVI BioPharma Announces FDA Clears IND Applications for Clinical Trials of RNA Therapeutic Agents for Treatment of Ebola and Marburg Viruses, Accessed Apil 2, 2015, 2 pages (Dec. 30, 2008).
Merki, E. et al., Antisense oligonucleotide directed to human apolipoprotein B-100 reduces lipoprotein(a) levels and oxidized phospholipids on human apolipoprotein B-1 00 particles in lipoprotein(a) transgenic mice, Circulation, 118(7): 743-53 (2008).
Mesmaeker, A.D. Backbone modifications in oligonucleotides and peptide nucleic acid systems, Current Opinion in Structural Biology, 5: 343-355 (1995).
Methods in Enzymology, Edited by Widder, K. and Green, R., Drug and Enzyme Targeting, Academic Press, 112: 309-396 (1985).
Mignet, N. et al., Synthesis and evaluation of glucuronic acid derivatives as alkylating agents for the reversible masking of internucleoside groups of antisense oligonucleotides, Carbohydrate Research, 303:17-24 (1997).
Mignet, N. et al., The Prooligonucleotide Approach. V: Influence of the phosphorus atom environment on the hydrolysis of enzymolabile dinucleoside phosphotriesters, Bioorganic and Medicinal Chemistry Letters, 7(7):851-854 (1997).
Milkowski, J.D. et al., Thiol Protection with the Acetamidomethyl Group: S-Acetamidomethyl-l-cysteine Hydrochloride, Organic Syntheses, 6: 5 (1988).
Monteys, A.M. et al., Single nucleotide seed modification restores in vivo tolerability of a toxic artificial miRNA sequence in the mouse brain, Nucleic Acids Res., 42(21): 13315-13327 (2014).
Morales-Rojas, H. and Kool, E.T., A porphyrin C-nucleoside incorporated into DNA, Organic Letters, 4(25):4377-4380 (2002).
Morcos, P.A., Achieving targeted and quantifiable alteration of mRNA splicing with Morpholino oligos, Biochem. Biophys. Res. Commun., 358(2): 521-527 (2007).
Morvan, F. et al., Cellular uptake and intracellular quantification of fluorescent labeled T20 Me-SATE prooligonucleotides, Nucleosides Nucleotides Nucleic Acids, 20(4-7):1165-1168 (2001).
Morvan, F. et al., Kinetics study of the biotransformation of an oligonucleotide prodrug in cells extract by matrix-assisted laser desorption/ionization time-of-flight mass spectrometry, Nucleosides, Nucleotides and Nucleic Acids, 20(2-4):1159-1163 (2001).
Morvan, F. et al., The Oligonucleotide Prodrug Approach: The Pro-Oligonucleotides, Pharmaceutical Aspects of Oligonucleotides, 79- 97 (2000).
Moser, H. E. et al., Sequence-Specific Cleavage of Double Helical DNA by Triple Helix Formation, Science, 238: 645-650 (1987).

(56) References Cited

OTHER PUBLICATIONS

Nawrot et al., DNA Oligonucleotides Containing Stereodefined Phosphorothioate Linkages in Selected Positions, Current Protocols in Nucleic Acid Chemistry, Unit 4.34: 4.34.1-4.34.15 (2009).
Nielsen, N. M. and Bundgaard, H. Glycolamide Esters as Biolabile Prodrugs of Carboxylic Acid Agents: Synthesis, Stability, Bioconversion, and Physicochemical Properties, Journal of Pharmaceutical Sciences, 77(4): 285-298 (1988).
Nieuwlandt, D. et al., In Vitro Selection of RNA Ligands to Substance P, Biochemistry, 34: 5651-5659 (1995).
Nilsson et al., Chemical and Stereochemical Aspects of Oxidative Coupling of H-Phosphonate and H-Phosphonothioate Diesters. Reactions with N,N-,N,O and O,O-Binucleophiles, Letters in Organic Chemistry, 2(2): 188-197 (2005).
Nilsson et al., Controlling Stereochemistry During Oxidative Coupling. Preparation of Rp or Sp Phosphoramidates from One P-chiral Precursor, Chem. Commun., (22): 2566-7 (2004).
Nilsson, J. et al., Chemoselectivity in oxidative coupling of bifunctional nucleophiles with dinucleoside H-phosphonate and dinucleoside H-phosphonothioate diesters, Nucleosides, Nucleotides & Nucleic Acids, 22(5-8):1467-1469 (2003).
Nowotny, M. et al., Structure of human RNase H1 complexed with an RNA/DNA hybrid: insight into HIV reverse transcription, Mol Cell, 28(2):264-76 (2007).
Nukaga, Y. et al., Stereocontrolled Solid-Phase Synthesis of Phosphorothioate Oligoribonucleotides Using 2'-O-(2-Cyanoethoxymethyl)-nucleoside 3'-O-Oxazaphospholiidine Monomers, Journal of Organic Chemistry, 77(18):7913-7922 (2012).
O'Connell, D. et al., Calcium-dependent oligonucleotide antagonists specific for L-selectin, Proc. Natl. Acad. Sci. USA, 93: 5883-5887 (1996).
Ohgi, T. et al., A New RNA Synthetic Method with a 2'-O-(2-Cyanoethoxymethyl) Protecting Group, Org. Lett., 7(16): 3477-3480 (2005).
Ohkubo et al., Synthesis of oligodeoxyribonucleotides containing hydroxymethylphosphonate bonds in the phosphoramidite method and their hybridization properties, Tetrahedron Letters, 46(51): 8953-8957 (2005).
Oka, N. and Wada, T., Stereocontrolled synthesis of oligonucleotide analogs containing chiral internucleotidic phosphorus atoms, Chemical Society Reviews, 40(12):5829-5843 (2011).
Oka, N. et al., An oxazaphospholidine approach for the stereocontrolled synthesis of oligonucleoside phosphorothioates, Journal of the America Chemical Society, 125(27):8307-8317 (2003).
Oka, N. et al., Diastereocontrolled Synthesis of Dinucleoside Phosphorothioates Using a Novel Class of Activators, Dialkyl(cyanomethyl)ammonium Tetrafluoroborates, Journal of the American Chemical Society, 124(18):4962-4963 (2002).
Oka, N. et al., Solid-Phase Synthesis of Stereoregular Oligodeoxyribonucleoside Phosphorothioates Using Bicyclic Oxazaphospholidine Derivatives as Monomer Units, Journal of the American Chemical Society, 130(47):16031-16037 (2008).
Oka, N. et al., Stereocontrolled synthesis of dinucleoside boranophosphates by an oxazaphospholidine method, Nucleic Acids Symposium Series, (49): 131-132 (2005).
Oka, N. et al., Stereocontrolled Synthesis of Oligoribonucleoside Phosphorothioates by an Oxazaphospholidine Approach, Organic Letters, 11(4):967-970 (2009).
Ostergaard, M. et al., Rational design of antisense oligonucleotides targeting single nucleotide polymorphisms for potent and allele selective suppression of mutant Huntingtin in the CNS, Nucleic Acids Research, 41(21), 9634-9650 (2013).
Otting, G. et al., Why Pentose—and Not Hexose-Nucleid Acids? Part IV. 'Homo-DNA': 1H-, 13C-, 31 P-, and 15N-NMR-Spectroscopic Investigation of ddGlc(A-A-A-A-T-T-T-T-T) in Aqueous Solution, Helvetica Chimica Acta, 76(8):2701-2756 (1993).
Padmanabhan, S. et al., Anti-HBV nucleotide prodrug analogs: Synthesis, bioreversibility, and cytotoxicity studies, Bioorganic and Medicinal Chemistry Letters, 16(15):1491-1494 (2006).

Pan, Q-W. et al., New therapeutic opportunities for Hepatitis C based on small RNA, World J. Gastroenterol., 13(33): 4431-4436 (2007).
Patil et al., Syntheses and properties of oligothymidylate analogs containing stereoregulated phosphorothioate and phosphodiester linkages in an alternating manner, Bioorganic & Medicinal Chemistry Letters, 4(22): 2663-2666 (1994).
Perrino, E. et al., New sulfurated derivatives of valproic acid with enhanced histone deacetylase inhibitory activity, Bioorganic & Medicinal Chemistry Letters, 18(6): 1893-1897 (2008).
Peyrottes, S. et al., SATE pronucleotide approaches: an overview, Mini-Reviews Medicinal Chemistry, 4(4):395-408 (2004).
Pfister, E.L. et al., Five siRNAs targeting three SNPs may provide therapy for three-quarters of Huntington's disease patients, 19(9): 774-778 (2009).
Pitsch, S. et al., Reliable Chemical Synthesis of Oligoribonucleotides (RNA) with 2'-0-[(Triisopropylsilyl)oxy]methyl(2'-0-tom)-Protected Phosphoramidites, Helvetica Chimica Acta, 84: 3773-3795 (2001).
Poijarvi, P. et al., 2,2-Bis(ethoxycarbonyl)—and 2-(Alkylaminocarbonyl)-2-cyano-Substituted 3-(Pivaloyloxy)propyl Groups as Biodegradable Phosphate Protections of Oligonucleotides, Bioconjugate Chemistry, 16(6):1564-1571 (2005).
Poijarvi, P. et al., The chemical stability of S-(2-acylthioethyl) and S-acyloxymethyl protected thymidylyl-3',5'-thymidine phosphoromonothiolates and their deacylation products in aqueous solution, Nucleosides Nucleotides and Nucleic Acids, 20(1-2):77-91 (2001).
Poijarvi, P. et al., Towards Nucleotide Prodrugs Derived from 2,2-Bis(hydroxymethyl)malonate and Its Congeners: Hydrolytic Cleavage of 2-Cyano-2-(hydroxymethyl)-3-methoxy-3-oxopropyl and 3-(Alkylamino)-2-cyano-2-(hydroxymethyl)-3-oxopropyl Protections from the Internucleosidic Phosphodiester and Phosphorothioate Linkages, Helvetica Chimica Acta, 85(7):1869-1876 (2002).
Poijarvi, P. et al., Towards Oligonucleotide Pro-Drugs: 2,2-Bis(ethoxycarbonyl) and 2-(Alkylaminocarbonyl)-2-cyano Substituted 3-(Pivaloyloxy)Propyl Groups as Biodegradable Protecting Groups for Internucleosidic Phosphoromonothioate Linkages, Letters in Organic Chemistry, 1(2):183-188 (2004).
Poijarvi, P., Prodrug Approaches of Nucleotides and Oligonucleotides, Current Medicinal Chemistry, 13(28):3441-3465 (2006).
Pon, R. T., Solid-Phase Supports for Oligonucleotide Synthesis, Current Protocols in Nucleic Acid Chemistry, 3.1.1-3.1.28 (2000).
Potter, B.V.L. et al., Synthesis and Configurational Analysis of Dinucleoside Phosphate Isotopically Chiral at Phosphorus. Stereochmical Course of Penicillium citrum Nuclease P1 Reaction, Biochemistry, 22: 1369-1377 (1983).
Prakash, T.P. et al., 2'-0-[2-(Methylthio )ethyl]-Modified Oligonucleotide: An Analogue of 2'—0-[2-(Methoxy)-ethyl]-Modified Oligonucleotide with Improved Protein Binding Properties and High Binding Affinity to Target RNA, Biochemistry, 41: 11642-11648 (2002).
Prhavc, M. et al., 2'-0[2[2-(N,N-Dimethylamino)ethoxy]ethyl] Modified Oligonucleotides: Symbiosis of Charge Interaction Factors and Stereoelectronic Effects, Organic Letters, 5(12): 2017-2020 (2003).
Puri, N. et al, Targeted Gene Knockout by 2'-O-Aminoethyl Modified Triplex Forming Oligonucleotides, J. Biol. Chem., 276: 28991-28998 (2001).
Ravikumar, V.T. et al., Unylinker: An Efficient and Scaleable Synthesis of Oligonucleotides Utilizing a Universal Linker Molecule: A Novel Approach to Enhance the Purity of Drugs, Org. Process Res. Dev., 12(3): 399-410 (2008).
Reese, C.B. and Yan, H., Solution phase synthesis of ISIS 2922 (Vitravene) by the modified H-phophane approach, J. Chem. Soc., Perkin Trans. I, 2619-2633 (2002).
Reither, S. and Jeltsch, A., Specificity of DNA triple helix formation analyzed by a FRET assay, BMC Biochemistry, 3: 9 pages (2002).
Revankar, G. R. and Rao, T.S., DNA with Altered Bases, DNA and Aspects of Molecular Biology, Comprehensive Natural Products Chemistry, 7.09: 313-339 (1999).

(56) References Cited

OTHER PUBLICATIONS

Robinson, D.S. et al., Predominant TH2-Like Bronchoalveolar T-Lymphocyte Population in Atopic Asthma, The New England Journal of Medicine, 326: 298-304 (1992).
Schoning, K.-U. et al., Chemical Etiology of Nucleic Acid Structure: the α-Threofuranosyl-(3'->2') Oligonucleotide System, Science, 290(5495):1347-1351 (2000).
Schultz, C., Prodrugs of Biologically Active Phospate Esters, Bioorganic and Medicinal Chemistry, 11(6):885-898 (2003).
Schulz, W.G. and Cai, S.L., Synthetic Genetics, Chemical and Engineering News, 5 (2012).
Seela et al, Diastereomerically pure Rp and Sp dinucleoside H-phosphonates. The stereochemical course of their conversion into P-methylphosphonates, phosphorothioates and [18O] chiral phosphates, Journal of Organic Chemistry, 56(12): 3861-3869 (1991).
Seidman, M.M. and Glazer, P.T. The potential for gene repair via triple helix formation, The Journal of Clinical Investigation, 112(4): 487-494 (2003).
Sergueeva et al., Synthesis of Dithymidine Boranophosphates via Stereospecific Boronation of H-phosphonate Diesters and Assignment of their Configuration, Tetrahedron Letters, 40: 2041-2044 (1999).
Seth, P.P. et al., An Exocyclic Methylene Group Acts as a Bioisostere of the 2'Oxygen Atom in LNA, J. Am. Chem. Soc, 132(42): 14942-14950 (2010).
She, X. et al., Synergy between Anti-Endoglin (CD105) Monoclonal Antibodies and TGF-βin Suppression of Growth of Human Endothelial Cells, Int. J. Cancer, 108: 251-257 (2004).
Silverman, R.H., A scientific journey through the 2-5A/RNase L system, Cytokine Growth Factor Reviews, 18(5-6):381-388 (2007).
Skotte, N.H. et al., Allele-specific suppression of mutant huntingtin using antisense oligonucleotides: providing a therapeutic option for all Huntington disease patients, PLoS One, 9(9): e107434 1-18 (2014).
Small, L.D. et al.,Comparison of Some Properties of Thiolsulfonates and Thiolsulfinates, Journal of the American Chemical Society, 71(10): 3565-3566 (1949).
Smith, A. et al., The murine haemopexin receptor, Biochem. J., 276: 417-425 (1991).
Sobkowski, et al. Stereochemistry of internucleotide bond formation by the H?phosphonate method. 1. Synthesis and 31P NMR analysis of 16 diribonulceoside (3'5')-H-phosphonates and the corresponding phosphorothioates, Nucleosides Nucleotides Nucleic Acids, 24(10-12): 1469-84 (2005).
Sonveaux, E., Protecting Groups in Oligonucleotide Synthesis, Protocols for Oligonucleotide Conjugates, Methods in Molecular Biology, Edited by Agrawal, S., Humana Press, 26: 1-71 (1994).
Spinelli, N. et al., Use of Allylic Protecting Groups for the Synthesis of Base-Sensitive Prooligonucleotides, European Journal of Organic Chemistry, 49-56 (2002).
Stawinski et al., Nucleoside H-phosphonates. 14. Synthesis of nucleoside phosphoroselenoates and phosphorothioselenoates via stereospecific selenization of the corresponding H-phosphonate and H-phosphonothioate diesters with the aid of new selenium-transfer reagent, 3H-1,2-benzothiaseleno1-3-one, J. Org. Chem., 59(1): 130-136 (1994).
Stawinski et al., Stereospecific oxidation and oxidative coupling of H-phosphonate and H-phosphonothioate diesters, Tetrahedron Letters, 33(22):3185-3188 (1992).
Stawinski, J. and Stromberg, R. Di—and Oligonucleotide Synthesis Using *H*-Phosphonate Chemistry, Methods in Molecular Biology, 288: 81-100 (2005).
Stawinski, J. and Thelin, M., 3-*H*-2,1-benzoxathiol-3-one 1-oxide—A New Reagent for Stereospecific Oxidation of Nucleoside H-Phosphonothioate Diesters, Tetrahedron Letters, 33(22): 3189-3192 (1992).
Stawinski, J. And Thelin, M., 3*H*-1,2-benzothiaselenol-3-one. A new selenizing reagent for nucleoside H-phosphonate and H-phosphonothioate diesters, Tetrahedron Letters, 33(47): 7255-7258 (1992).
Stec et al., Deoxyribonucleoside 3'-O-(2-Thio—and 2-Oxo-"spiro"-4,4-pentamethylene-1,3,2-oxathiaphospholane)s:? Monomers for Stereocontrolled Synthesis of Oligo(deoxyribonucleoside phosphorothioate)s and Chimeric PS/PO Oligonucleotides, J. Am. Chem. Soc., 120(29): 7156-7167 (1998).
Stec et al., Oxathiaphospholane Method of Stereocontrolled Synthesis of Diribonucleoside 3', 5'-Phosphorothiptes, J. Org. Chem., 61(19): 6713-6716 (1996).
Stec et al., Stereocontrolled Synthesis of Oligo (nucleoside phosphorothioate)s , Angew. Chem. Int. Ed. Engl., 33:709-722 (1994).
Stec et al., Stereospecific Synthesis of P-Chiral Analogs of Oligonucleotides, Methods in Molecular Biology, 20: 285-313 (1993).
Stec et al., Synthesis of Phosphorothioate Oligonucleotides with Stereodefined Phsphorothioate Linkages, Current Protocols in Nucleic Acid Chemistry, Unit 4.17: 4.17.14.17.28 (2003).
Stec, Oligo(nucleoside Phosphorothioate)s: The Quest of P-Chirality, in Phosphorus, Sulfur, and Silicon, 177(6): 1775-1778 (2002).
Stec, W.J. et al., Diastereomers of Nucleoside 3'-O-(2-Thio-1,3,2-oxathia(selena)phospholanes): Building Blocks for Stereocontrolled Synthesis of Oligo(nucleoside phosphorothioate)s, Journal of the American Chemical Society, 117(49):12019-12029 (1995).
Stec, W.J. et al., Novel route to oligo(deoxyribonucleoside phosphorothioates). Stereocontrolled synthesis of P-chiral oligo(deoxyribonucleoside phosphorothioates), Nucleic Acids Research, 19(21):5883-5888 (1991).
Stec, W.J. et al., Stereodependent inhibition of plasminogen activator inhibitor type 1 by phosphorothioate oligonucleotides: proof of sequence specificity in cell culture and in vivo rat experiments, Antisense Nucleic Acid Drug Dev., 7(6):567-73 (1997).
Stein, C.A. and Cheng, Y.C., Antisense oligonucleotides as therapeutic agents—is the bullet really magical?, Science, 261(5124):1004-12 (1993).
Sureshbabu, V.V. et al., Synthesis of tetrazole analogues of amino acids using Fmoc chemistry: isolation of amino free tetrazoles and their incorporation into peptides, Tetrahedron Letters, 48(39): 7038-7041 (2007).
Suska, A. et al., Antisense oligonucleotides: Stereocontrolled synthesis of phosphorothioate oligonucleotides, Pure and Applied Chemistry, 65(4):707-714 (1993).
Takeno, H. et al., Selection of an RNA Molecule that Specifically Inhibits the Protease Activity of Subtilisin, J. Biochem., 125: 1115-1119 (1999).
Tamura et al., Preparation of Stereoregulated Antisense Oligodeoxyribonucleoside Phoshorothioate and Interaction with its Complementary DNA and RNA, Nucleosides & Nucleotides,17(1-3): 269-282 (1998).
Tang, J. et al., Enzymatic Synthesis of Stereoregular (All Rp) Oligonucleotide Phosphorothioate and Its Properties, Nucleosides Nucleotides, 14(3-5):985-990 (1995).
Tawarada, R. et al., Mechanistic studies on oxidative condensation of a thymidine 3'-H-phosphonate derivative with 3'-O-acetylthymidine, Archive for Organic Chemistry, (3):264-273 (2009).
Thayer, J.R. et al., Separation of oligonucleotide phosphorothioate distereoisomers by pellicular anion-exchange chromatography, Journal of Chromatography A, 1218: 802-808 (2011).
Tomoskozi et al., Stereospecific conversion of H-phosphonates into phosphoramidates. The use of vicinal carbon-phosphorus couplings for configurational determination of phosphorus, Tetrahedron, 51(24): 6797-6804 (1995).
Tosquellas, G. et al., First synthesis of alternating SATE-phosphotriester/phosphodiester prooligonucleotides on solid support, Bioorganic and Medicinal Chemistry Letters, 8(20): 2913-2918 (1998).
Tosquellas, G. et al., Prooligonucleotides exhibit less serum-protein binding than phosphodiester and phosphorothioate oligonucleotides, Nucleosides, Nucleotides and Nucleic Acids, 19(5-6):995-1003 (2000).

(56) References Cited

OTHER PUBLICATIONS

Tosquellas, G. et al., The pro-oligonucleotide approach: solid phase synthesis and preliminary evaluation of model pro-dodecathymidylates, Nucleic Acids Research, 26(9):2069-2074 (1998).
Tosquellas, G. et al., The Prooligonucleotide Approach III: Synthesis and bioreversibility of a chimeric phosphorodithioate prooligonucleotide, Bioorganic and Medicinal Chemistry Letters, 6(4):457-462 (1996).
Tosquellas, G. et al., The Prooligonucleotide Approach IV : Synthesis of chimeric prooligonucleotides with 6 enzymolabile masking groups and unexpected desulfurization side reaction, Bioorganic and Medicinal Chemistry Letters, 7(3):263-268 (1997).
Tsai, C.H. et al., Enzymatic synthesis of DNA on glycerol nucleic acid templates without stable duplex formation between product and template, Proceedings of the National Academy of Science, 104(37):14598-14603 (2007).
Tuerk, C. and Gold, L., Systematic Evolution of Ligans by Exponential Enrichment: RNA Ligands to Bacteriophage T4 DNA Polymerase, Science, 249: 505-510 (1990).
Turner, D.H. et al, Improved Parameters for Prediction of RNA Structure, Cold Spring Harbor Symposia on Quantitative Biology, LII: 123-133 (1987).
Turner, D.H. et al., Free Energy Increments for Hydrogen Bonds in Nucleic Acid Base Pairs, J. Am. Chem. Soc., 109: 3783-3785 (1987).
Uphoff, K.W. et al., In vitro selection of aptamers: the death of pure reason, Curr. Opin. Struct. Biol., 6: 281-288 (1996).
Uznanski, B. et al., Stereochemistry of base-catalyzed ring opening of 1,3,2-oxathiaphospholanes. Absolute configuration of 2-{N-](Rc)-1-(.alpha.-naphthypethyl)ethyl]amino}-2-thiono-1,3,2-oxathiaphospholanes and O,S-dimethyl N-[(Rc)-1-(.alpha.-naphthyl)ethyl]phosphoramidothioates, Journal of the American Chemical Society, 114(26): 10197-10202 (1992).
Van Der Veken, P. et al., Irreversible inhibition of dipeptidyl peptidase 8 by dipeptide-derived diaryl phosphonates, Journal of Medicinal Chemistry, 50(23): 5568-5570 (2007).
Vasquez, K.M. et al., Chromosomal mutations induced by triplex-forming oligonucleotides in mammalian cells, Nucl. Acids Res. 27(4): 1176-1181 (1999).
Verma, S. and Eckstein, F., Modified Oligonucleotides: Synthesis and Strategy for Users, Annu. Rev. Biochem., 67: 99-134 (1998).
Vermeulen, A. et al., Double-Stranded Regions Are Essential Design Components of Potent Inhibitors of RISC Function, RNA, 13: 723-730 (2007).
Vives, E. et al., Lipophilic pro-oligonucleotides are rapidly and efficiently internalized in HeLa cells, Nucleic Acids Research, 27(20):4071-4076 (1999).
Vlassov, V.V. et al., Transport of oligonucleotides across natural and model membranes, Biochimica et Biophysica Acta, 1197: 95-108 (1994).
Vu, H. and Hirschbein, B.L., Internucleotide Phosphite Sulfurization With Tetraethylthiuram Disulfide. Phosphorothioate Oligonucleotide Synthesis Via Phosphoramidite Chemistry, Tetrahedron Letters, 32(26):3005-3008 (1991).
Vuyisich, M. and Beal, P.A., Regulation of the RNA-dependent protein kinase by triple helix formation, Nuc, Acids Res., 28(12): 2369-74 (2000).
Wada et al., Stereocontrolled Synthesis of Phosphorothioate RNA by the Oxazaphospholidine Approach, Nucleic Acids Symp. Ser., 48: 57-58 (2004).
Wada, T. et al., Chemical synthesis and properties of stereoregulated phosphorothioate RNAs, Nucleic Acids Symposium Series, 51: 119-120 (2007).
Wada, T. et al., Stereocontrolled synthesis of phosphorothioate DNA by an oxazaphospholidine approach, Nucleic Acids Research Supplement, 3:109-110 (2003).
Wagner, C.R. et al., Pronucleotides: toward the in vivo delivery of antiviral and anticancer nucleotides, Medicinal Research Reviews, 20(6): 417-451 (2000).
Wan et al., Synthesis of Second Generation Antisense Oligonucleotides Containing Chiral Phosphorothioate Linkages and Evaluation of their Biophysical Properties and Biological Activity, 10th Annual Meeting of the Oligonucleotide Therapeutics Society, abstract received by Applicant Oct. 7, 2014, poster setup prior to presentation (first known to Applicant late Oct. 12, 2014, PST), poster presentation Oct. 13, 2014.
Wan, W.B. et al., Synthesis, biophysical properties and biological activity of second generation antisense oligonucleoties containing chiral phosphorothioate linkages, Nucleic Acid Research, 27 pages, online advance access (2014).
Wang H, et al., Therapeutic gene silencing delivered by a chemically modified siRNA against mutant SOD 1 slows ALS progression, The Journal of Biological Chemistry, 283(23):15845-15852 (2008).
Warby, S.C. et al., CAG expansion in the Huntington disease gene is associated with a specific and targetable predisposing haplogroup, Am. J. Hum. Genet., 84(3): 351-366 (2009).
Weidner, J.P. et al., Alkyl and Aryl Thiolsulfonates, Journal of Medicinal Chemistry, 7(5): 671-673 (1964).
Weiser, T.G., et al., An estimation of the global vol. of surgery: a modeling strategy based on available data, Lancet, 372(9633): 139-144 (2008).
Wengel, J., Synthesis of 3'-C- and 4'-C-Branched Oligodeoxynucleotides and the Development of Locked Nucleic Acid (LNA), Ace. Chem. Res., 32: 301-310 (1999).
Widdison, W. C. et al., Semisynthetic Maytansine analogues for the targeted treatment of cancer, Journal of Medicinal Chemistry, 49(14): 4392-4408 (2006).
Wilk, A. and Stec, W.J., Analysis of oligo(deoxynucleoside phosphorothioate)s and their diastereomeric composition, Nucleic Acids Research, 23(3):530-534 (1995).
Wilk, A. et al., Deoxyribonucleoside Cyclic N-Acylphosphoramidites as a New Class of Monomers for the Stereocontrolled Synthesis of Oligothymidylyl—and Oligodeoxycytidylyl-Phosphorothioates, Journal of the American Chemical Society, 122(10): 2149-2156 (2000).
Wright, P. et al., Large scale synthesis of oligonucleotides via phosphoramidite nucleosides and a high-loaded polystyrene support, Tetrahedron Letters, 34(21):3373-3736 (1993).
Written Opinion for PCT/IB2009/007923, 8 pages dated (Sep. 6, 2010).
Written Opinion for PCT/US2010/041068, 11 pages, dated (Sep. 1, 2010).
Written Opinion for PCT/US2011/064287, 14 pages dated (Apr. 12, 2012).
Written Opinion for PCT/US2012/046805, 9 pages dated (Sep. 19, 2012).
Written Opinion for PCT/US2013/050407, 12 pages dated (Jan. 9, 2014).
Xiang, Y. et al., Effects of RNase L mutations associated with prostate cancer on apoptosis induced by 2',5'-oligoadenylates, Cancer Research, 63(20):6795-6801 (2003).
Xiong, H.Y. et al., The human splicing code reveals new insights into the genetic determinants of disease, Science, 347(6218): 144 (2015).
Xu, L. et al., Cyclic ADP-ribose analogues containing the methylenebisphosphonate linkage: effect of pyrophosphate modifications on Ca2+ release activity, J. Med. Chem., 48(12): 4177-4181 (2005).
Yamada, O. et al., Diastereoselective Synthesis of 3,4-Dimethoxy-7-morphinanone: A Potential Route to Morphine, Organic Letters, 2(18): 2785-2788 (2000).
Yamamoto, S. et al., Unique Palindromic Sequences in Synthetic Oligonucleotides are Required to Induce INF and Augment INF-Mediated Natural Killer Activity, J. Immunol., 148(12): 4072-4076 (1992).
Zhang, L. et al., A simple glycol nucleic acid, Journal of the American Chemical Society,127(12):4174-4175 (2005).
Zhang, R.S. et al., Synthesis of two mirror image 4-helix junctions derived from glycerol nucleic acid, Journal of the American Chemical Society, 130(18):5846-5847 (2008).

(56) References Cited

OTHER PUBLICATIONS

Zhao, J. et al., Genome-wide Identification of Polycomb-Associated RNAs by RIP-seq, Molecular Cell, 40: 939-953 (2010).
Zlatev et al., Phosphoramidate dinucleosides as hepatitis C virus polymerase inhibitors, J Med Chem., 51(18): 5745-57 (2008).
Zon, Automated synthesis of phosphorus-sulfur analogs of nucleic acids-25 years on: potential therapeutic agents and proven utility in biotechnology, New J. Chem., 34(5): 795-804 (2010).
Zon, G and Stec, W.J., Phosphorothioate oligonucleotides, Oligonucleotides and Analogues: A Practical Approach, 87-108 (1991).
Aldrich Chemical Co. Catalog, 2007-2008 Issue, only p. 1719 supplied: see first full entry at col. 1 (S-methyl methanethiosulfonate), Milwaukee, WI.
Communication Relating to the Results of the Partial International Search of PCT/IB2015/000395, Annex to Form PCT/ISA/206, 3 pages (Aug. 24, 2015).
Engelhardt, J.A. et al., Scientific and Regulatory Policy Committee Points-to-consider Paper: Drug-induced Vascular Injury Associated with Nonsmall Molecule Therapeutics in Preclinical Development: Part 2. Antisense Oligonucleotides, Toxicologic Pathology, XX: 1-10 (2015).
Frazier, K. et al., Potential Mechanisms of vascular toxicity in Monkeys with antisense oligonucleotides, TIDES oligo conference, 1-25 (May 15, 2014).
Inagawa, T. et al., Inhibition of human immunodeficiency virus type 1 replication by P-stereodefined oligo(nucleoside phosphorothioate)s in a long-term infection model, FEBS Letters, 528(1-3): 48-52 (2002).
Kay, C. et al., Huntingtin Haplotypes Provide Prioritized Target Panels for Allele-Specific Silencing in Huntington Disease Patients of European Ancestry, Molecular Therapy, Accepted Article Preview Online (Jul. 23, 2015).
Koziolkiewicz, M. et al., Effect of P-chirality of oligo(deoxyribonucleoside phosphorothioate)s) on the activity of terminal deoxyribonucleotidyl transferase, FEBS Letters, 434(1-2): 77-82 (1998).
Liang, X-h. et al., Identification and characterization of intracellular proteins that bind oligonucleotides with phosphorothioate linkages, Nucleic Acids Research, 43(5): 2927-2945, Supplemental Data pp. 1-20 (2015).
Liu, W. et al., Increased Steady-State Mutant Huntingtin mRNA in Huntington's Disease Brain, Journal of Huntington's Disease 2: 491-500 (2013).
Lu, Y., Recent advances in the stereocontrolled synthesis of antisense phosphorothioates, Mini Reviews in Medicinal Chemistry, 6(3): 319-330 (2006).
Pharmacology Review(s), Application No. 203568Orig1s000, Center for Drug Evaluation and Research, Food and Drug Administration, Department of Health & Human Services, 2013.
Senn, J.J. et al., Non-CpG-Containing Antisense 2-Methoxyethyl Oligonucleotides Activate a Proinflammatory Response Independent of Toll-Like Receptor 9 or Myeloid Differentiation Factor 88, The Journal of Pharmacology and Experimental Therapeutics, 314: 972-979 (2005).
Sheehan, J.P. and Phan, T.M. Phosphorothioate Oligonucleotides Inhibit the Intrinsic Tenase Complex by an Allosteric Mechanism, Biochemistry, 40: 4980-4989 (2001).
Singhrao, S.K. et al., Increased Complement Biosynthesis by Microglia and Complement Activation on Neurons in Huntington's Disease, Experimental Neurology, 159: 362-376 (1999).
Walker, J.R. et al., Structure of the Ku heterodimer bound to DNA and its implications for double-strand break repair, Nature, 412: 607-614 (2001).
Wild, E. et al., Quantification of mutant huntingtin protein in cerebrospinal fluid from Huntington's disease patients, The Journal of Clinical Investigation, 125(5): 1979-1986 (2015).
Xu, D. and Esko, J.D., Demystifying Heparan Sulfate—Protein Interactions, Annu. Rev. Biochem., 83: 129-157 (2014).

Yanai, H. et al., Suppression of immune responses by nonimmunogenic oligodeoxynucleotides with high affinity for high-mobility group box proteins (HMGBs), PNAS Early Edition, 1-6 (2011).
Aartsma-Rus, A. et al., Targeted exon skipping as a potential gene correction therapy for Duchenne muscular dystrophy, Neuromuscular Disorders, 12: S71-S77 (2002).
Ager, D.J. The Peterson olefination reaction, Organic Reactions, 38:1-223 (2004).
Agrawal, S. and Kandimalla, E.R., Antisense and/or Immunostimulatory Oligonucleotide Therapeutics, Current Cancer Drug Targets, Bentham Science, 1(3): 1 page. URL: <http:www.eurekaselect.com/65087/article> [Retrieved Apr. 3, 2016].
Bartz, H. et al., Poly-guanosine strings improve cellular uptake and stimulatory activity of phosphodiester CpG oligonucleotides in human leukocytes, Vaccine, 23: 148-155 (2004).
Block, S.S. and Weidner, J.P, Vibrational Behavior and Structure of Disulfide Dioxides (Thiolsulfonates), Applied spectroscopy, 20(2): 71-73 (1966).
Bonora, G.M. et al., Large scale, liquid phase synthesis of oligonucleotides by the phosphoramidite approach, Nucleic Acids Research, 21(5): 1213-1217 (1993).
Campbell, J. et al., Hybrid polymer/MOF membranes for Organic Solvent Nanofiltration (OSN): Chemical modification and the quest for perfection, Journal of Membrance Science, 503: 166-176 (2016).
Cankurtaran, E.S. et al., Clinical Experience with Risperidone and Memantine in the Treatment of Huntington's Disease, Journal of the National Medical Association, 98(8): 1353-1355 (2006).
CAS Registry No. 1225524-67-3; STN Entry Date May 28, 2010; α-[(2-methylphenyl)methyl]-2-Pyrrolidinemethanol.
CAS Registry No. 1225524-68-4; STN Entry Date May 28, 2010; α-[(4-methylphenyl)methyl]-2-Pyrrolidinemethanol.
CAS Registry No. 1225545-00-5; STN Entry Date May 28, 2010; α-[(2,4,6-trimethylphenyl)methyl]-2-Pyrrolidinemethanol.
CAS Registry No. 1225554-20-0; STN Entry Date May 28, 2010; α-[(4-ethylphenyl)methyl]-2-Pyrrolidinemethanol.
CAS Registry No. 1225594-74-0; STN Entry Date May 28, 2010; α-[(2-chloro-6-fluorophenyl)methyl]-2-Pyrrolidinemethanol.
CAS Registry No. 1225682-42-7; STN Entry Date May 30, 2010; α-[(4-chlorophenyl)methyl]-2-Pyrrolidinemethanol.
CAS Registry No. 1226037-41-7; STN Entry Date May 30, 2010; α-[(3-chlorophenyl)methyl]-2-Pyrrolidinemethanol.
CAS Registry No. 1226118-97-3; STN Entry Date May 30, 2010; α-[(3-bromophenyl)methyl]-2-Pyrrolidinemethanol.
CAS Registry No. 1226119-02-3; STN Entry Date May 30, 2010; α-[(4-bromophenyl)methyl]-2-Pyrrolidinemethanol.
CAS Registry No. 1226146-65-1; STN Entry Date May 30, 2010; α-[(2,4-dimethylphenyl)methyl]-2-Pyrrolidinemethanol.
CAS Registry No. 1226160-20-8; STN Entry Date May 30, 2010; α-[(2,5-dimethylphenyl)methyl]-2-Pyrrolidinemethanol.
CAS Registry No. 1226178-36-4; STN Entry Date May 30, 2010; α-[(2-fluorophenyl)methyl]-2-Pyrrolidinemethanol.
CAS Registry No. 1226188-06-2; STN Entry Date May 30, 2010; α-[[4-(1-methylethyl)phenyl]methyl]- 2-Pyrrolidinemethanol.
CAS Registry No. 1226204-20-1; STN Entry Date May 30, 2010; α-[(3-methylphenyl)methyl]-2-Pyrrolidinemethanol.
CAS Registry No. 1226231-44-2; STN Entry Date May 30, 2010; α-[(2-chlorophenyl)methyl]-2-Pyrrolidinemethanol.
CAS Registry No. 1226352-28-8; STN Entry Date May 30, 2010; α-[(2,4-dichlorophenyl)methyl]-2-Pyrrolidinemethanol.
CAS Registry No. 1226352-38-0; STN Entry Date May 30, 2010; α-[(3,4-dichlorophenyl)methyl]-2-Pyrrolidinemethanol.
CAS Registry No. 1226413-27-9; STN Entry Date May 30, 2010; α-(phenylmethyl)- 2-Pyrrolidinemethanol.
CAS Registry No. 1226419-15-3; STN Entry Date May 30, 2010; α-[(4-fluorophenyl)methyl]-2-Pyrrolidinemethanol.
CAS Registry No. 1263282-82-1 ; STN Entry Date Feb. 21, 2011; (S)-[(diphenyl)methyl]-2-Pyrrolidinemethanol.
Chang, W. et al., Systematic chemical modifications of single stranded siRNAs significantly improved CTNNB1 mRNA silencing, Bioorg. Med. Chem. Lett., 1-5 (2016), http://dx.doi.org/10.1016/j.bmcl.2016.07.064.

(56) References Cited

OTHER PUBLICATIONS

De Koning, M.C. et al., Simple and Efficient Solution-Phase Synthesis of Oligonucleotides Using Extractive Work-Up, Organic Process Research & Developmen, 10: 1238-1245 (2006).

Documents submitted to and/or received from the United States Securities and Exchange Commission; downloaded from EDGAR (Dec. 17, 2015 to Oct. 4, 2016).

Gaffney, P.R.J. et al., Liquid-Phase Synthesis of 2'-Methyl-RNA on a Homostar Support through Organic-Solvent Nanofiltration, Chem. Eur. J., 21:1-10 (2015).

Gould, W.A. et al., Pyrrolidines IX. 3-Aryl-3-pyrrolidinols, Journal of Medicinal Chemistry, 7(1): 60-67 (1964).

Guerciolini, R., Allele-selective Silencing of Mutant Huntingtin by Stereopure Oligonucleotides, WAVE Life Sciences, Huntington's Disease Society of America, HDSA Presentation 2016 (Jun. 3, 2016).

International Preliminary Report on Patentability for PCT/JP2013/069107, 10 pages dated (Jan. 15, 2015).

International Search Report for PCT/JP15/50716 and English Translation, 8 pages dated (Apr. 21, 2015).

International Search Report for PCT/JP2015/050714, and English Translation, 8 pages dated (Apr. 21, 2015).

International Search Report for PCT/JP2015/050718 and English Translation, 8 pages dated (Apr. 21, 2015).

International Search Report for PCT/US2016/043598, 4 pages dated (Nov. 28, 2016).

International Search Report of PCT/JP2013/069107, 2 pages dated (Oct. 1, 2013).

Iwamoto, N. et al., Optimization of Therapeutic Phosphorothioate Oligonucleotides by P-Chirality Control, WAVE Life Sciences, PSJ Congress: The Pharmaceutical Society of Japan, (Mar. 25, 2015-Mar. 28, 2016).

Kaur, H. et al., Activation of natural killer-like YT-INDY cells by oligodeoxynucleotides and binding by homologous pattern recognition proteins, Scandinavian Journal of Immunology, 62: 361-370 (2005).

Kay, C. et al., Huntingtin Haplotypes Provide Prioritized Target Panels for Allele-specific Silencing in Huntington Disease Patients of European Ancestry, The American Society of Gene & Cell Therapy, 1-13 (2015).

Kim, D. et al., Immunostimulation and anti-DNA antibody production by backbone modified CpG-DNA, Biochemical and Biophysical Research Communicationes, 379: 362-367 (2009).

Kim, M., Beta conformation of polyglutamine track revealed by a crystal structure of Huntingtin N-terminal region with insertion of three histidine residues, Prion, 7(3): 221-228 (2013).

Kim, S. et al., Liquid-Phase RNA Synthesis by Using Alkyl-Chain-Soluble Support, Chem. Eur. J., 19: 8615-8620 (2013).

Kremer, B. et al., A Worldwide Study of the Huntington's Disease Mutation, The New England Journal of Medicine, 330(20): 1401-1406 (1994).

Krieg, A.M., Development of TLR9 agonists for cancer therapy, The Journal of Clinical Investigation, 117(5): 1184-1194 (2007).

Kungurtsev, V. et al., Solution-Phase Synthesis of Short Oligo-2'-deoxyribonucleotides by Using Clustered Nucleosides as a Soluble Support, Eur. J. Org. Chem., 6687-6693 (2013).

Kuramoto, Y. et al., Mannosylated cationic liposomes/CpG DNA complex for the treatment of hepatic metastasis after intravenous administration in mice, Journal of Pharmaceutical Science, 98(3): 1193-1197 (2009).

Matsuno, Y. et al., Synthetic Method for Oligonucleotide Block by Using Alkyl-Chain-Soluble Support, Org. Lett., 18: 800-803 (2016).

Meena, Control of Human RNase H Mediated Cleavage by Stereopure Phosphorothioate Oligonucleotides, WAVE Life Sciences, TIDES Meeting (May 3-6, 2015).

Meena, Development of Allele Specific Antisense Oligonucleotides, WAVE Life Sciences, ACS Central Regional Meeting (CERM), Covington, KY (May 19, 2016).

Meena, Development of Allele Specific Antisense Oligonucleotides, WAVE Life Sciences, TIDES Meeting (May 11, 2016).

Meena, et al., Therapeutic Implications of Controlling P-Chirality in Phosphorothioate Oligonucleotides, TIDES Poster (May 12-15, 2014).

Meena, Optimization of Antisense Drugs by P-Stereochemistry Control, WAVE Life Sciences, OTS Annual Meeting 2014, Oligonucleotide Therapeutics Society (Oct. 12-14, 2014).

Molenkamp, B.G. et al., Local Administration of PF-3512676 CpG-B Instigates Tumor-Specific CD8+ T-Cell Reactivity in Melanoma Patients, Clin. Cancer Res., 14(14): 4532-4542 (2008).

Molina, A.G. et al., Acetylated and Methylated β-Cyclodextrins asViable Soluble Supports for the Synthesis of Short 2'-Oligodeoxyribo-nucleotides in Solution, Molecules, 17: 12102-12120 (2012).

Molina, A.G. et al., Assembly of Short Oligoribonucleotides from Commercially Available Building Blocks on a Tetrapodal Soluble Support, Current Organic Synthesis, 12:1-6 (2015).

Molina, A.G. et al., Solution phase synthesis of short oligoribonucleotides on a precipitative tetrapodal support, Beilstein Journal of Organic Chemistry, 10: 2279-2285 (2014).

Molina, A.G., Synthesis of Short Oligonucleotides on a Soluble Support by the Phosphoramidite Method, University of Turku, 1-66 (2015).

Monteys, A.M. et al., Artificial miRNAs Targeting Mutant Huntingtin Show Preferential Silencing In Vitro and I Vivo, Molecular Therapy—Nucleic Acids, 4: e234 1-11 (2015).

Nukaga, Y. et al., Stereocontrolled Solid-Phase Synthesis of Phosphate/Phosphorothioate (PO/PS) Chimeric Oligodeoxyribonucleotides on an Automated Synthesizer Using an Oxazaphospholidine-Phosphoramidite Method, J. Org. Chem., A-J, 10 pages (Publication Date (Web): Mar. 3, 2016).

Pérez, B. et al., Antisense Mediated Splicing Modulation for Inherited Metabolic Diseases: Challenges for Delivery, Nucleic Acid Therapies, 24(1): 48-56 (2014).

Regan, J.F. et al., A Rapid Molecular Approach for Chromosomal Phasing, PLOS ONE, 1-15 (2015).

Rossetti, G., Structural aspects of the Huntingtin protein investigated by biocomputing methods, Thesis, RWTH Aachen University, Forschungszentrum Juelich, 173 pages (2011).

Schmitz, C. et al., Synthesis of P-Stereogenic Phosphoramidite and Phosphorodiamidite Ligands and Their Application in Asymmetric Catalysis, Eur. J. Org. Chem., 6205-6230 (2015).

Scrimgeour, E.M. Huntington Disease (Chorea) in the Middle East, SQU. Med. J., 9(1): 16-23 (2009).

Seth, P., and Olson, R., Nucleic Acid Therapeutics—Making Sense of Antisesnse, 2016 Drug Design and Delivery Symposium, ACS Webinar, 1-36 (Jul. 26, 2016).

Stec, W.J. and Zon, G., Stereochemical Studies of the Formation of Chiral Internucleotide Linkages by Phosphormadite Coupling in the Synthesis of Oligodeocyribonucleotides, Tetrahedron Letters, 25(46): 5279-5282 (1984).

Stec, W.J. et al., Automated Solid-Phase Synthesis, Separation, and Stereochemistry of Phosphorothioate Analogues of Oligodeocyribonucleotides, J. Am. Chem. Soc., 106: 6077-6079 (1984).

Takahashi, D. et al., Novel diphenylmethyl-Derived Amide Protecting Group for Efficient Liquid-Phase Peptide Synthesis: AJIPHASE, Org. Lett., 14(17): 4514-4517 (2012).

Tam, Journal of Hematotherapy & Stem Cell Research, 12: 467-471 (2003).

Wan, W.B. and Seth, P.P., The Medicinal Chemistry of Therapeutic Oligonucleotides, J. Med. Chem., 59: 9645-9667 (2016).

WAVE Life Sciences Press Release, WAVE Life Sciences Added to the Russell 2000® Index, 2 pages (Jun. 27, 2016).

WAVE Life Sciences Press Release, WAVE Life Sciences Announces Plan to Deliver Six Clinical Programs by 2018, 6 pages (Jan. 29, 2016).

WAVE Life Sciences Press Release, WAVE Life Sciences Announces Pricing of Initial Public Offering, 3 pages (Nov. 11, 2015).

WAVE Life Sciences Press Release, WAVE Life Sciences Appoints Dr. Michael Panzara as Head of Neurology Franchise, 4 pages (Jul. 12, 2016).

(56) References Cited

OTHER PUBLICATIONS

WAVE Life Sciences Press Release, WAVE Life Sciences Appoints Keith Regnante as Chief Financial Officer, 4 pages (Aug. 17, 2016).
WAVE Life Sciences Press Release, WAVE Life Sciences Appoints Roberto Guerciolini, M. Senior Vice President and Head of Early Development, 2 pages (Apr. 7, 2015).
WAVE Life Sciences Press Release, WAVE Life Sciences Closed $18 Million Series a Financing to Advance Stereopure Nucleic Acid Therapeutics, 3 pages (Feb. 2, 2015).
WAVE Life Sciences Press Release, WAVE Life Sciences Enters Collaboration with Pfizer to Develop Genetically Targeted Therapies for the Treatment of Metabolic Diseases, 5 pages (May 5, 2016).
WAVE Life Sciences Press Release, WAVE Life Sciences Expands Stereopure Synthetic Chemistry Platform Capabilities, Augments Patent Portfolio with Addition of Single-Stranded RNAi (ssRNAi), 3 pages (Jun. 8, 2015).
WAVE Life Sciences Press Release, WAVE Life Sciences Raises $66 Million in Series B Financing, 3 pages (Aug. 18, 2015).
WAVE Life Sciences Press Release, WAVE Life Sciences Receives Orphan Drug Designation from FDA for its Lead Candidate Designed to Treat Huntington's Disease, 5 pages (Jun. 21, 2016).
WAVE Life Sciences Press Release, WAVE Life Sciences Reports First Quarter 2016 Financial Results and Provides Business Update, 9 pages (May 16, 2016).
WAVE Life Sciences Press Release, WAVE Life Sciences Reports Fourth Quarter and Full Year 2015 Financial Results and Provides Business Update, 10 pages (Mar. 30, 2016).
WAVE Life Sciences Press Release, WAVE Life Sciences Reports Second Quarter 2016 Financial Results and Provides Business Update, 10 pages (Aug. 15, 2016).
WAVE Life Sciences Press Release, WAVE Life Sciences to Advance Next-Generation Nucleic Acid Therapies to Address Unmet Need in Duchenne Muscular Dystrophy, 6 pages (May 9, 2016).
WAVE Life Sciences Press Release, WAVE Life Sciences to Present at the Deutsche Bank 41st Annual Health Care Conference, 2 pages (Apr. 29, 2016).
WAVE Life Sciences Press Release, WAVE Life Sciences to Present at the Jefferies 2016 Healthcare Conference, 2 pages (Jun. 1, 2016).
WAVE Life Sciences Press Release, WAVE Life Sciences to Present at the JMP Securities Life Sciences Conference, 2 pages (Jun. 15, 2016).
Wave Life Sciences Press Release, WAVE Life Sciences to Present at the LEERINK Partner 5th Annual Global Healthcare Conference, 2 pages (Feb. 3, 2016).
WAVE Life Sciences Press Release, WAVE Life Sciences to Present at the Leerink Partners Rare Disease & Immuno-Oncology Roundtable, 2 pages (Sep. 14, 2016).
WAVE Life Sciences Press Release, WAVE Life Sciences to Present at the SunTrust Robinson Humphrey 2016 Orphan Drug Day Conference, 2 pages (Feb. 16, 2016).
Written Opinion for PCT/JP15/50716 and English Translation, 11 pages dated (Apr. 21, 2015).
Written Opinion for PCT/JP2015/050714, and English Translation, 11 pages dated (Apr. 21, 2015).
Written Opinion for PCT/JP2015/050718 and English Translation, 6 pages dated (Apr. 21, 2015).
Written Opinion for PCT/US2016/043598, 10 pages dated (Nov. 28, 2016).
Yamato, K. et al., Enhanced specificity of HPV16 E6E7 siRNA by RNA-DNA chimera modification, Cancer Gene Therapy, 18: 587-597 (2011).
Yu, D. et al., Accessible 5'-end of CpGcontaining phosphorothioate oligodeoxynucleotides is essential for immunostimulatory activity, Bioorganic & Medicinal Chemistry Letters, 10: 2585-2588 (2000).
Yu, D. et al., Single-Stranded RNAs Use RNAi to Potently and Allele-Selectively Inhibit Mutant Huntingtin Expression, Cell, 150: 895-908 (2012).

Zhang, J. et al., Optimization of Exon Skipping Therapies for Duchenne Muscular Dystrophy, WAVE Life Sciences, PPMD: Parent Project Muscular Dystrophy Meeting, Orlando, FL (Jul. 25, 2016).
Fearon, K. et al., Phosphorothioate oligodeoxynucleotides: large-scale synthesis and analysis, impurity characterization, and the effect of phosphorus stereochemistry, Oligonucleotides as Therapeutic Agents, Ciba Found. Symp. 209: 19-31 (1997).
International Search Report for PCT/US2016/043542, 6 pages (dated Dec. 28, 2016).
Written Opinion for PCT/US2016/043542, 14 pages (dated Dec. 28, 2016).
Aaronson, J.G. et al., Rapid HATU-Mediated Solution Phase siRNA Conjugation, Bioconjugate. Chem., 22: 1723-1728 (2011).
Aartsma-Rus, A. et al., Antisense-Induced Multiexon Skipping for Duchenne Muscular Dystrophy Makes More Sense, Am. J. Hum. Genet., 74:83-92 (2004).
Aartsma-Rus, A. et al., Therapeutic antisense-induced exon skipping in cultured muscle cells from six different DMD patients, Human Molecular Genetic, 12(8):907-914 (2003).
Anthony, K. et al., Exon Skipping Quantification by Quantitative Reverse-Transcription Polymerase Chain Reaction in Duchenne Muscular Dystrophy Patients Treated with the Antisense Oligomer Eteplirsen, Human Gene Therapy Methods, 23: 336-345 (2012).
Birts, C.N. et a., Transcription of Click-Linked DNA un Human Cells, Angew. Chem. Int. Ed., 53:2362-2365 (2014).
Blade, H. et al., Modular Synthesis of Constrained Ethyl (cEt) Purine and Pyrimidine Nucleosides, J. Org. Chem., 80: 5337-5343 (2015).
Burgers, P. M. J. et al., Stereochemistry of Hydrolysis by Snake Venom Phosphodiesterase, J. Biol. Chem., 254(16): 7476-7478 (1979).
Burgers, P.M.J. and Eckstein, F., A Study of the Mechanism of DNA Polymerase I from *Escherichia coli* with Diastereomeric Phosphorothioate Analogs of Deoxyadenosine Triphosphate, J. Biol. Chem., 254(15): 6889-6893 (1979).
Burgers, P.M.J. and Eckstein, F., Diastereomers of 5'-O-adenosyl 3'O-uridyl phosphorothioate: chemical synthesis and enzymatic properties, Biochemistry, 18: 592-596 (1979).
Chak, L-L, and Okamura, K., Argonaute-dependent small RNAs derived from single-stranded, non-structured precursors, Frontiers in Genetics, 5(172): 1-15 (2014).
Chan, J.H.P. et al., Antisense Oligonucleotides: From Design to Therapeutic Application, Clinical and Experimental Pharmacology and Physiology, 33: 544-540 (2006).
Chappell, C. et al., Involvement of human polynucleotide kinase in double-strand break repair by non-homologous end joining, The EMBO Journal, 21(11): 2827-2832 (2002).
Cheloufi, S. et al., A Dicer-independent miRNA biogenesis pathway that requires Ago catalysis, Nature, 465(7298): 584-589 (2010).
Chen, B. and Bartlett, M., A One-Step Solid Phase Extradion Method for Bioanalysis of a Phosphorothioate Oligonucleotide and Its 3' n-1 Metabolite from Rat Plasma by uHPLC-MS/MS, The AAPS Journal, 14(4): 772-780 (2012).
Chmielewski, M.K. and Markiewicz, W.T., Novel Method of Synthesis of 5"-Phosphate 2'-O-ribosyl-ribonucleosides and Their 3'-Phosphoramidites, Molecules, 18:14780-14796 (2013).
Cieslak, J. et al., 31P NMR Study of the Desulfurization of Oligonucleoside Phosphorothioates Effected by "Aged" Trichloroacetic Acid Solutions, J. Org. Chem., 70:3303-3306 (2005).
Crooke, S.T., Antisense Strategies, Current Molecular Medicine, 4: 465-487 (2004).
Crooke, S.T., Progress in Antisense Technology, Annu. Rev. Med., 55: 61-95 (2004).
Dejesus-Hernandez, M. et al., Expanded GGGGCC hexanucleotide repeat in non-coding region of C9ORF72 causes chromosome 9p-linked frontotemporal dementia and amyotrophic lateral sclerosis, Neuron, 72(2): 245-256 (2011).
Dias, N. and Stein, C.A., Antisense Oligonucleotides: Basic Concepts and Mechanisms, Molecular Cancer Therapeutics, 1: 347-355 (2002).

(56) References Cited

OTHER PUBLICATIONS

Dikfidan, A. et al., RNA Specificity and Regulation of Catalysis in the Eukaryotic Polynucleotide Kinase Clp1, Molecular Cell, 54: 975-986 (2014).
Documents submitted to and/or received from the United States Securities and Exchange Commission; downloaded from EDGAR (Nov. 9, 2016 to May 10, 2017).
Donnelly, C.J. et al., RNA Toxicity from the ALS/FTD C90RF72 Expansion Is Mitigated by antisense Intervention, Neuron, 80:415-428 (2013).
Efimov, V.A. et al., Rapid synthesis of long-chain deoxyribooligonucleotides by the N-methylimidazolide phosphotriester method, Nucleic Acids Research, 11(23): 8369-8387 (1983).
Egholm, M. et al., PNA hybridizes to complementary oligonucleotides obeying the Watson-Crick hydrogen-bonding rules, Nature, 365, 566-568 (1993).
El-Sagheer, A.H. and Brown, T., Efficient RNA synthesis by in vitro transcription of a triazole-modified DNA template, Chem. Commun., 47(44):12057-12058 (2011).
El-Sagheer, A.H. and Brown, T., New strategy for the synthesis of chemically modified RNA constructs exemplified by hairpin and hammerhead ribozymes, PNAS, 107(35):15329-15334 (2010).
El-Sagheer, A.H. et al., Biocompatible artificial DNA linker than is read through by DNA polymerases and is functional in *Escherichia coli*, PNAS, 108(28):11338-11343 (2011).
Erler, W. et al., Patient Advisory Board Meeting, WAVE Life Sciences, London, 46 pages (Mar. 2, 2017).
Erler, W., Stereopure Exon 51-Skipping Oligonucleotide as a Potential Disease-Modifying Therapy for Duchenne Muscular Dystrophy, WAVE Life Sciences, 10 pages (2017).
Ewles, M. et al, Quantification of oligonucleotides by LC-MS/MS: the challenges of quantifying a phosphorothioate oligonucleotide and multiple metabolites, Bioanalysis, 6(4), 447-464 (2014).
Exiqon, Locked Nucleic Acid (LNA), Custom Oligonucleotides for RNA and DNA Research, 16 pages (Aug. 2009).
Freschauf, G., Identification of Small Molecule Inhibitors of the Human DNA Repair Enzyme Polynucleotide Kinase/Phosphatase, Master of Science in Experimental Oncology Thesis, University of Alberta, 155 pages (2011).
Gallier, F. et al., 5',6'-Nucleoside Phosphonate Analogues Architecture: Synthesis and Comparative Evaluation towards Metabolic Enzymes, Chem Med Chem, 6: 1094-1106 (2011).
Giacometti, R.D. et al., Design, synthesis, and duplex-stabilizing properties of conformationally constrained tricyclic analogues of LNA, Org. Biomol. Chem, 14: 2034-2040 (2016).
Gryaznov, S. and, CHEN, J.-K., Oligodeoxyribonucleotide N3'4P5' Phosphoramidates: Synthesis and Hybridization Properties, J. Am. Chem. Soc., 116: 3143-3144 (1994).
Hagedorn, P.H. et al., Locked nucleic acid: modality, diversity, and drug discovery, Drug Discovery, 1-14 (Oct. 2017).
Haringsma, H.J. et al., mRNA knockdown by single strand RNA is improved by chemical modifications, Nucleic Acids Research, 40(9): 4125-4136 (2012).
Heemskerk, H.A. et al., In vivo comparison of 2'-O-methyl phosphorothioate and morpholino antisense oligonucleotides for Duchenne muscular dystrophy exon skipping, The Journal of Gene Medicine, 11:257-266 (2009).
Hendrix, C. et al., 1',5'-Anhydrohexitol Oligonucleotides: Synthesis, Base Pairing and Recognition by Regular Oligodeoxyribonucleotides and Oligoribonucleolides, Chem. Eur. J., 3(1): 110-120 (1997).
Hirama, T. et al., PCR-Based Rapid Identification System Using Bridged Nucleic Acids for Detection of Clarithromycin-Resistant Mycobacterium avium-M. Intracellulare Complex Isolates, Journal of Clinical Microbiology, 54(3): 699-704 (2016).
Hirose, M. et al., MDM4 expression as an indicator of TP53 reactivation by combined targeting of MDM2 and MDM4 in cancer cells without TP53 mutation, Oncoscience, 1(12): (2014).

Hu, J. et al., Allele-Selective Inhibition of Huntingtin Expression by Switching to an miRNA-like RNAi Mechanism, Chemisty & Biology 17: 1183-1188 (2010).
Hu, J. et al., Exploring the Effect of Sequence Length and Composition on Allele-Selective Inhibition of Human Huntingtin Expression by Single-Stranded Silencing RNAs, Nucleic Acid Therapeutics, 24(3): 199-209 (2014).
Hu, J. et al., Recognition of c9orf72 Mutant RNA by Single-Stranded Silencing RNAs, Nucleic Acid Therapeutics, 8 (2016). Supplementaiy Figure, 1 page.
Hyrup., B. and Nielsen, P.E., Peptide Nucleic Acids (PNA): Synthesis, Properties and Potential Applications, Bioorg. Med. Chem., 4(1): 5-23 (1996).
International Search Report for PCT/US2016/056123, 5 pages (dated Mar. 17, 2017).
International Search Report for PCT/US2017/022135, 3 pages (dated Jun. 6, 2017).
International Search Report for PCT/US2017/0307530, 6 pages (dated Sep. 26, 2017).
International Search Report for PCT/US2017/030777, 5 pages (dated Oct. 2, 2017).
International Search Report for PCT/US2017/035837, 4 pages (dated Aug. 24, 2017).
International Search Report for PCT/US2017/043431, ISA/US, 5 pages (dated Dec. 21, 2017).
International Search Report for PCT/US2017/045218, 3 pages (dated Sep. 27, 2017).
Isis Pharmaceuticals, Inc. 2014 Annual Report Improving Patients' Lives by Treating Disease Through Targeting RNA, 192 pages (2014).
*Isis Pharmaceuticals, Inc.* v. *Santaris Pharma A/S Corp.*, Order Denying Defendants' Motion For Summary Judgment Without Prejudice, Case No. 11cv02214 BTM (KSC), United States District Court, S.D. California, 5 pages (Sep. 19, 2012).
Iwamoto, N. et al., Control of phosphorothioate stereochemistry substantially increases the efficacy of antisense oligonucleotides, Nature Biotechnology, Life Sciences Reporting Summary, 6 pages (2017).
Iwamoto, N. et al., Control of phosphorothioate stereochemistry substantially increases the efficacy of antisense oligonucleotides, Nature Biotechnology, pp. 1-9 (2017).
Iwamoto, N. et al., Control of phosphorothioate stereochemistry substantially increases the efficacy of antisense oligonucleotides, Nature Biotechnology, Supplementary Methods, Supplementary Tables 1-4, and Supplementary Note, 23 pages (2017).
Iwamoto, N. et al., Control of phosphorothioate stereochemistry substantially increases the efficacy of antisense oligonucleotides, Nature Biotechnology, Supplementary Text and Figures 1-9, 13 pages (2017).
Iwamoto, N. et al., Control of phosphorothioate stereochemistry substantially increases the efficacy of antisense oligonucleotides, Nature Biotechnology, with Supplemental Data, 19 pages (2017).
Jepsen, J.S. et al., LNA-Antisense Rivals Sirna for Gene Silencing, Current Opinion In Drug Discovery and Development, 7(2): 188-194 (2004).
Jepsen, J.S. et al., Locked Nucleic Acid: A Potent Nucleic Acid Analog in Therapeutics and Biotechnology, Oligonucleolides, 14: 130-146 (2004).
Jones, R.J. et al., Synthesis and binding properties of pyrimidine oligodeoxynucleoside analogs containing neutral phosphodiester replacements: The Formacetal and 3'-Thioformacetal Internucleoside Linkages, J. Org. Chem, 58: 2983-2991 (1993).
Kashida, H. et al., Acyclic artificial nucleic acids with phosphodiester bonds exhibit unique functions, Polymer Journal, 1-6 (2016).
Kay, C. et al., Personalized gene silencing therapeutics for Huntington disease, Clinical Genetics, 1-8 (2014).
Kim, S-K. et al., Bridged Nucleic Acids (BNAs) as Molecular Tools, J Biochem Mol Biol Res., 1(3): 67-71 (2015).
Koch, T., A New Dimension in LNA Therapeutics, Roche Innovation Center, Copenhagen, Denmark, Presentation, 39 pages (May 3, 2017).

(56) References Cited

OTHER PUBLICATIONS

Koizumi, M. et al., Triplex formation with 2'-O,4'-C-ethylene-bridged nucleic acids (ENA) having C3'-endo conformation at physiological pH, Nuc. Acids Res., 31(12): 3267-3273 (2003).
Koseoglu, M. et al., Effects of hemolysis interference on routine biochemistry parameters. Biochemia Medica., 21(1): 79-85 (2011). Retrieved May 18, 2017, URL: <http://www.biochemia-medica.com/2011/21/79>.
Koshkin, A.A. et al., LNA (Locked Nucleic Acids): Synthesis of the Adenine, Cytosine, Guanine, 5-Methylcytosine, Thymine and Uracil Bicyclonucleoside Monomers, Oligomerisation, and Unprecedented Nucleic Acid Recognition, Tetrahedron 54: 3607-3630 (1998).
Kretschmer-Kazemi Far, R. and Sczakiel, G., The activity of siRNA in mammalian cells is related to structural target accessibility: a comparison with antisense oligonucleotides, Nucleic Acids Research, 31 (15):4417-4424 (2003).
Krieg, A.M., Therapeutic potential of Toll-like receptor 9 activation, Nature Reviews, 471-484 (2006).
Krotz, A.H. et al., Phosphorothioate Oligonucleotides with Low Phosphate Diester Content: Greater than 99.9% Sulfurization Efficiency with "Aged" Solutions of Phenylacetyl Disulfide (PADS), Organic Process Research & Development, 8: 852-858 (2004).
Kumar, R. et al., The First Analogues of LNA (Locked Nucleic Acids): Phosphorothioate-LNA and 2'-THIO-LNA, Bioo. Med. Chem. Let., 8: 2219-2222 (1998).
Lahiri, N., Shooting the messenger with single-stranded RNA gene silencing, edited by Wild, E., HDBuzz, 7 pages (Sep. 24, 2012). Retrieved Oct. 7, 2015. URL: http://en.hdbuzz.net/099.
Lauritsen, A. et al., Methylphosphonate LNA: A Locked Nucleic Acid with a Methylphosphonate Linkage, Bioo. Med. Chem. Lett., 13: 253-256 (2003).
Lauritsen, A. et al., Oligodeoxynucleotides containing amide-linked LNA-type dinucleotides: synthesis and high-affinity nucleic acid hybridization, Chem. Comm., 5: 530-531 (2002).
Lee, K-W et al., CG sequence- and phosphorothioate backbone modification-dependent activation of the NF-κB-responsive gene expression by CpG-oligodeoxynucleotides in human RPMI 8226 B cells, Molecular lmmonulogy, 41: 955-964 (2004).
Leviten, M., Wave's Purity Progress, Biocentury, 1-6 (Sep. 28, 2017).
Li, M. et al., Synthesis and cellular activity of stereochemically-pure 2'-O-(2-methoxyethyl)- phosphorothioate oligonucleotides, Chem. Commun., 53: 541-544 (2017).
Liu, J. et al., Modulation of Splicing by Single-Stranded Silencing RNAs, Nucleic Acid Therapeutics, 25(3): 113-120 (2015).
Lopez, C. et al., Inhibition of AAC(6')-lb-Mediated Resistance to Amikacin in Acinetobacter baumannii by an Antisense Peptide-Conjugated 2',4'- Bridged Nucleic Acid-NC-DNA Hybrid Oligomer, Antimicrobial Agents and Chemotherapy, 59(9): 5798-5803 (2015).
Martinez, J. et al., Single-Stranded Antisense siRNAs Guide Target RNA Cleavage in RNAi, Cell, 110: 563-574 (2002).
Martinez-Montero, S. et al., Locked 2'-Deoxy-2',4'-Difluororibo Modified Nucleic Acids: Thermal Stability, Structural Studies, and siRNA Activity, ACS Chem. Biol., 10: 2016-2023 (2015).
Matranga, C. at al., Passenger-Strand Cleavage Facilitates Assembly of siRNA into Ago2-Containing RNAi Enzyme Complexes, Cell, 123: 607-620 (2005). Supplemental Data, 6 pages.
Matsui, M. et al., Algonaute 2-dependent Regulation of Gene Expression by Single-stranded miRNA Mimics, Molecular Therapy, 10 pages (2016).
Matsui, M. et al., Transcriptional Silencing by Single-Stranded RNAs Targeting a Noncoding RNA That Overlaps a Gene Promoter, ACS Chem. Biol., 8: 122-126 (2013).
Meena, et al., Discovery and Early Clinical Development of the First Allele-Specific Stereopure ASO Drug Candidate with Disease—Modifying Potential for the Treatment of Huntington's Disease, WAVE Life Sciences, Poster, 1 page (2016).

Mesmaeker, A.D. et al. Amides as a New Type of Backbone Modification in Oligonucleotides, Angew. Chem., Int. Ed. Engl., 33: 226-229 (1994).
Midturi, J. et al., Spectrum of Pulmonary Toxicity Associated with the Use of Interferon Therapy for Hepatitis C: Case Report and Review of the Literature, Clinical Infectious Diseases, 39(11): 1724-1729 (2004).
Morita, K. et al., 2'-O,4'-C-Ethylene-bridged nucleic acids (ENA) with nuclease-resistance and high affinity for RNA, Nucl. Acids Res., Supp. 1: 241-242 (2001).
Morita, K. et al., 20-O,40-C-Ethylene-Bridged Nucleic Acids (ENA): Highly Nuclease-Resistant and Thermodynamically Stable Oligonucleotides for Antisense Drug, Bioo. Med. Chem. Lett., 12: 73-76 (2002).
Morita, K. et al., Synthesis and properties of 2'-O,4'-C-Ethylene-bridged nucleic acids (ENA) as effective antisense oligonucleotides, Bioorganic & Medicinal Chemistry, 11(10): 2211-2226 (2003).
Nencka, R. et al., Novel Conformationally Locked Nucleosides and Nucleotides, Collection Symposoim Series, 14: 119-122 (2014).
Nielsen, P.E. and Haaima, G., Peptide nucleic acid (PNA). A DNA mimic with a pseudopeptide backbone, Chem. Soc. Rev., 73-78 (1997).
Nielsen, P.E. et al., Sequence-Selective Recognition of DNA by Strand Displacement with a Thymine-Substituted Polyamide, Science, 254(5037): 1497-1500 (1991).
Nielsen, P.E. et al., Synthesis of 29-O,39-C-linked bicyclic nucleosides and bicyclic Oligonucleotides, J. Chem. Soc. Perkins Trans., 1: 3423-3433 (1997).
Obika et al. Stability and structural features of the duplexes containing nucleoside analogues with a fixed N-type conformation, 2'-O,4'- C-methyleneribonucleosides, Tetrahedron Lett. 39: 5401-5404 (1998).
Obika, S. et al., Synthesis of 2'-O,4'-C-Methyleneuridine and -cytidine. Novel Bicyclic Nucleosides Having a Fixed C a ,-endo Sugar Puckering, Tetrahedron Lett., 38(50): 8735-8 (1997).
Onizuka, K. et al., Short Interfering RNA Guide Strand Modifiers from Computational Screening, J. Am. Chem. Soc., 135: 17069-17077 (2013).
Osawa, T. et al., Synthesis and Properties of the 5-Methyluridine Derivative of 3,4-Dihydro-2H-pyran-Bridged Nucleic Acid (DpNA), J. Org. Chem., 80: 10474-10481 (2015).
Ostergaard, M.E. et al., Efficient Synthesis and Biological Evaluation of 5?-GalNAc Conjugated Antisense Oligonucleotides, Bioconjugate. Chem., 26: 1452-1455 (2015).
Pallan, P.S. et al., Structute and nuclease resistance of 20,40-constrained 20-O-methoxyethyl (cMOE) and 20-O-ethyl (cEt) modified DNAs, Chem. Comm., 48: 8195-8197 (2012).
Panzara, M. et al., Duchenne Muscular Dystrophy Advisory Board Meeting, WAVE Life Sciences, 70 pages (Mar. 3, 2017).
Parmer, R. et al., 5'-(E)-Vinylphosphonate: A Stable Phosphate Mimic Can Improve the RNAi Activity of siRNA-GalNAc Conjugates, Chem. Bio. Chem., 17: 1-6 (2016).
Pedersen, L. et al, A Kinetic Model Explains Why Shorter and Less Affine Enzyme-recruiting Oligonucleotides Can Be More Potent, Mol Ther Nucleic Acids, 3: e149 1-8 (2014).
Pendergraff, H.M. et al., Single-Stranded Silencing RNAs: Hit Rate and Chemical Modification, Nucleic Acid Therapeutics, 1-7 (2016).
Petersen, M. and Wengel, J., LNA: a versatile tool for therapeutics and genomics, TRENDS in Biotechnology, 21(2): 74-81 (2003).
Pontarollo, R.A. el al., Monocytes are required for optimum in vitro stimulation of bovine peripheral blood mononuclear cells by non-methylated CpG motifs, Veterinary Immunology and Immunopathology, 84(1-2): 43-59 (2002).
Prakash, T.P. et al., Identification of metabolically stable 5-phosphate analogs that support single-stranded siRNA activity, Nucleic Acids Research, 43(6): 2993-3011 (2015). Supplementary Data, 80 pages.
Prakash, T.P. et al., Lipid Nanoparticles Improve Activity of Single-Stranded siRNA and Gapmer Antisense Oligonucleotides in Animals, ACS Chem. Biol., 5 pages (2013), DOI: 10.1021/cb4001316.

(56) References Cited

OTHER PUBLICATIONS

Prakash, T.P. et al., Synergistic effect of phosphorothioate, 50-vinylphosphonate and GalNAc modifications for enhancing activity of synthetic siRNA, Bioorg. Med. Chem. Lett., 26: 2817-2820 (2016).
Prakash, T.P. et al., Targeted delivery of antisense oligonucleotides to hepatocytes using triantennary N-acetyl galactosamine improves potency 10-fold in mice, Nucleic Acids Res., 42(13): 8796-807 (2014).
Rajwanshi, V.K. et al., LNA stereoisomers: xylo-LNA (b-d-xylo configured locked nucleic acid) and a-I-LNA (a-I-ribo configured locked nucleic acid), Chem. Commun., 1395-1396 (1999).
Ravn, J. et al., Stereodefined LNA Phosphorthioate Oligonucleotides, Roche Pharma Research and Early Development, RTR Research, Roche Innovation Center Copenhagen, RNA & Oligonucleotide Therapeutics Meeting, Poster, 1 page (Mar. 29- Apr. 1, 2017).
Saetrom, P., Predicting the efficacy ofshon oligonucleotides in antisense and RNAi experiments with boosted genetic programming, Bioinformatics, 20(17): 3055-3063 (2004).
Sanhueza, C.A. et al., Efficient Liver Targeting by Polyvalent Display of a Compact Ligand for the Asialoglycoprotein Receptor, J. Am. Chem. Soc., 9 pages (2016).
Schirle, N. T. and MaCrae, I.J., The Crystal Structure of Human Argonaute2, Science, 336(6084): 1037-1040 (2012).
Schirle, N.T. et al., Structural analysis of human Argonaute-2 bound to a modified siRNA guide, J. Am. Chem. Soc., 1-6 (2016).
Schirle, N.T. et al., Structural Basis for micoRNA Targeting, Science, 346(6209): 608-613 (2014).
Schirle, N.T. et al., Water-mediated recognition of t1-adenosine anchors Argonaute2 to microRNA targets, eLife, 4: e07646 1-16 (2015).
Schultz, R.G. and Gryaznov, S.M., Oligo-24-fluoro-24-deoxynucleotide N34_P54 phosphoramidates: synthesis and properties, Nucleic Acids Res., 24(15): 2966-2973 (1996).
Seth, P.P. et al., Configuration of the 50-Methyl Group Modulates the Biophysical and Biological Properties of Locked Nucleic Acid (LNA) Oligonucleotides, J. Med. Chem., 53: 8309-8318 (2010).
Seth, P.P. et al., Design, Synthesis and Evaluation of Constrained Methoxyethyl, (cMOE) and Constrained Ethyl (cEt) Nucleoside Analogs, Nucleic Acids Symposium Series, 52(1), 553-554 (2008).
Seth, P.P. et al., Short Antisense Oligonucleotides with Novel 2'-4' Conformationaly Restricted Nucleoside Analogues Show Improved Potency without Increased Toxicity in Animals, J. Med. Chem., 52: 10-13 (2009).
Seth, P.P. et al., Structural requirements for hybridization at the 50-position are different in a-L-LNA as compared to b-D-LNA, Bioo. Med. Chem. Lett., 22: 296-299 (2012).
Seth, P.P. et al., Structure Activity Relationships of α-I-LNA Modified, Phosphorothioate Gapmer Antisense Oligonucleotides in Animals, Mol. Ther-Nuc. Acids, 1: e47 1-8 (2012).
Seth, P.P. et al., Synthesis and Biophysical Evaluation of 2',4'-Constrained 2'O-Methoxyethyl and 2',4'-Constrained 2'O-Ethyl Nucleic Acid Analogues, J. Org. Chem., 75: 1569-1581 (2010).
Shivalingam, A. et al., Molecular Requirements of High-Fidelity Replication-Competent DNA Backbones for Orthogonal Chemical Ligation, J. Am. Chem. Soc., 139(4):1575-1583 (2017).
Singh, P.P. et al., Universality of LNA-mediated high-affinity nucleic acid recognition, Chem. Comm., 1247-1248 (1998).
Singh, S.K. et al., Synthesis of 2'-Amino-LNA: A Novel Conformationally Restricted High-Affinity Oligonucleotide Analogue with a Handle, J. Org. Chem., 63: 10035-10039 (1998).
Singh, S.K. et al., Synthesis of Novel Bicyclo[2.2.1] Ribonucleosides: 2'-Amino- and 2'-Thio-LNA Monomeric Nucleosides, J. Org. Chem., 63: 6078-6079 (1998).
Sobkowski, M. et al., Recent Advances in H-Phosphonate Chemistry. Part 1. H-Phosphonate Esters: Synthesis and Basic Reactions, Top Curr Chem, 361:137-177 (2014).
Sorensen, M.D., Functionalized LNA (locked nucleic acid): high-affinity hybridization of oligonucleotides containing N-acylated and N-alkylated 2'-amino-LNA monomers, Chem. Comm., 2130-2131 (2003).
Stout, A.K. et al., Inhibition of wound healing in mice by local interferon a/b injection, Int J Exp Pathol, 74 (1): 79-85 (1993).
Surono, A. et al., Chimeric RNA/Ethylene Bridged Nucleic Acids Promote Dystrophin Expression in Myocytes of Duchenne Muscular Dystrophy by Inducing Skipping of the Nonsense Mutation-Encoding Econ, Human Gene Therapy, 15:749-757 (2004).
Suter, S.R. et al., Structure-Guided Control of siRNA Off Target Effects, J. Am. Chem. Soc., 1-9 (2016).
Takahashi, T. et al., Interactions between the non-seed region of siRNA and RNA-binding RLC/RISC proteins, Ago and TRBP, in mammalian cells, Nucleic Acids Research, 42(8): 5256-5269 (2014).
Takeshima, Y. et al., Oligonucleotides against a splicing enhancer sequence led to dystrophin production in muscle cells from a Duchenne muscular dystrophy patient, Brain & Development, 23:788-790 (2001).
Ts'o, P.O. et al., An Approach to Chemotherapy Based on Base Sequence Information and Nucleic Acid Chemistry, Ann. N. Y. Acad. Sci., 507: 220-241 (1988).
Van Aerschot, A. et al., 1,5-Anhydrohexitol Nucleic Acids, a New Promising Antisense Construc, Angew. Chem. Int. Ed. Engl., 34: 1338-1339 (1995).
Van Deutekom, J.C.T. et al., Antisense-induced exon skipping restores dystrophin expression in DMD patient derived muscle cells, Human Molecular Genetics, 10(15):1547-1554 (2001).
Vasseur, J-J. et al., Oligonucleosides: Synthesis of a Novel Methylhydroxylamine-Linked Nucleoside Dimer and Its Incorporation into Antisense Sequences, J. Am. Chem. Soc., 114: 4006-4007 (1992).
Veedu, R.N. et al., Novel Applications of Locked Nucleic Acids, Nucleic Acids Symposium Series, 51: 29-30 (2007).
Wang, Y. et al., Structure of an argonaute silencing complex with a seed-containing guide DNA and target RNA duplex, Nature, 456(7224): 921-926 (2008).
Watts, J.K. and Corey, D.R., Gene silencing by siRNAs and antisense oligonucleotides in the laboratory and the clinic, J. Pathol. 226(2): 365-79 (2012).
Weiner, G. J. et al., Immunostimulatory oligodeoxynucleotides containing the CpG motif are effective as immune adjuvants in tumor antigen immunization, 94(20): 10833-10837 (1997).
Weinfeld, M., et al., Influence of nucleic acid base aromaticity on substrate reactivity with enzymes acting on single-stranded DNA, Nucleic Acids Res., 21(3): 621-626 (1993).
Whittaker, B. et al., Stereoselective synthesis of highly functionalised P-stereogenic nucleosides via palladium-catalysed P-C cross-coupling reactions, Tetrahedron Letters, 49: 6984-6987 (2008).
Woolf, T.M. et al., Specificity of antisense oligonucleotides in vivo, Prov. Natl. Aca. Sci. USA, 89: 7305-7309 (1992).
Written Opinion for PCT/US2016/056123, 15 pages (dated Mar. 17, 2017).
Written Opinion for PCT/US2017/022135, 11 pages (dated Jun. 6, 2017).
Written Opinion for PCT/US2017/030753, 13 pages (dated Sep. 26, 2017).
Written Opinion for PCT/US2017/030777, 10 pages (dated Oct. 2, 2017).
Written Opinion for PCT/US2017/035837, 15 pages (dated Aug. 24, 2017).
Written Opinion for PCT/US2017/043431, ISA/US, 38 pages (dated Dec. 21, 2017).
Written Opinion for PCT/US2017/045218, 11 pages (dated Sep. 27, 2017).
Xu, Y. et al., Functional comparison of single- and double-stranded siRNAs in mammalian cells, Biochemical and Biophysical Research Communications, 316: 680-687 (2004).
Yasuda, K. et al., CpG motif-independent activation of TLR9 upon endosomal translocation of "natural" phosphodiester DNA, European Journal of Immunology, 431-436 (2006).

(56) References Cited

OTHER PUBLICATIONS

Ye, S. et al., An efficient procedure for genotyping single nucleotide polymorphisms, Nucleic Acids Research, 29(17): e88 1-8 (2001).
Zhang, Y. et al., Structural Isosteres of Phosphate Groups in the Protein Data Bank, J. Chem. Inf. Model, 1-18 (2017).
Zhang, Y., Investigating phosphate structural replacements through computational and experimental approaches, Academic Dissertain, University of Helsinki, 119 pages (2014).
Zhong, Z. et al., WAVE Life Sciences: Developing Stereopure Nucleic Acid Therapies for the Treatment of Genetic Neurological Diseases, World CNS Summit 2017, Boston, MA, WAVE Life Sciences, Poster, 1 page (Feb. 20-22, 2017).
Zlatev, I. et al., 5'-C-Malonyl RNA: Small Interfering RNAs Modified with 5'-Monophosphate Bioisostere Demonstrate Gene Silencing Activity, ACS Chem. Biol., 8 pages (2015).

* cited by examiner (PANEL A)

(PANEL B)

(PANEL C)

(PANEL D)

(PANEL E)

(PANEL F)

(PANEL G)

(PANEL H)

(PANEL I)

(PANEL J)

(PANEL K)

(PANEL A)

(PANEL B)

(PANEL C)

(PANEL D)

(PANEL E)

(PANEL F)

(PANEL G)

(PANEL H)

(PANEL I)

(PANEL J)

(PANEL K)

(PANEL A)

(PANEL B)

(PANEL A)

(PANEL B)

CHIRAL CONTROL

CROSS-REFERENCE TO RELATED APPLICATIONS

This application is a United States National Stage Application under 35 U.S.C. § 371 of International Application No. PCT/US13/50407, filed Jul. 12, 2013, which claims priority to U.S. Provisional Application Ser. No. 61/671,655, filed Jul. 13, 2012, 61/671,656, filed Jul. 13, 2012, 61/671,722, filed Jul. 14, 2012, and 61/671,724, filed Jul. 14, 2012, the entirety of each of which is incorporated herein by reference.

SEQUENCE LISTING

This application contains a Sequence Listing which has been submitted in ASCII format via EFS-Web and is hereby incorporated by reference in its entirety. Said ASCII copy, created on Oct. 2, 2017, is named 2010581-0108_SL.txt and is 539,924 bytes in size.

BACKGROUND OF THE INVENTION

Oligonucleotides are useful in therapeutic, diagnostic, research and nanomaterials applications. The use of naturally occurring nucleic acids (e.g., unmodified DNA or RNA) for therapeutics can be limited, for example, because of their instability against extra- and intracellular nucleases and/or their poor cell penetration and distribution. Additionally, in vitro studies have shown that properties of antisense oligonucleotides such as binding affinity, sequence specific binding to the complementary RNA (Cosstick and Eckstein, 1985; LaPlanche et al., 1986; Latimer et al., 1989; Hacia et al., 1994; Mesmaeker et al., 1995), and stability to nucleases can be affected by the absolute stereochemical configurations of the phosphorus atoms (Cook, et al. US005599797A). Therefore, there is a need for new and improved oligonucleotide compositions.

SUMMARY OF THE INVENTION

The present invention encompasses the recognition that there exists a need for chirally controlled oligonucleotide compositions and new methods for synthesizing the same. The invention specifically encompasses the identification of the source of certain problems with prior methodologies for preparing chiral oligonucleotides, including problems that prohibit preparation of fully chirally controlled compositions, particularly compositions comprising a plurality of oligonucleotide types.

In some embodiments, the present invention provides chirally controlled oligonucleotide compositions.

In some embodiments, the present invention provides methods of making chirally controlled oligonucleotides and chirally controlled oligonucleotide compositions.

In some embodiments, the present invention provides methods of using chirally controlled oligonucleotide and chirally controlled oligonucleotide compositions.

All publications and patent documents cited in this application are incorporated herein by reference in their entirety.

Definitions

Aliphatic: The term "aliphatic" or "aliphatic group", as used herein, means a straight-chain (i.e., unbranched) or branched, substituted or unsubstituted hydrocarbon chain that is completely saturated or that contains one or more units of unsaturation, or a monocyclic hydrocarbon or bicyclic or polycyclic hydrocarbon that is completely saturated or that contains one or more units of unsaturation, but which is not aromatic (also referred to herein as "carbocycle" "cycloaliphatic" or "cycloalkyl"), that has a single point of attachment to the rest of the molecule. In some embodiments, aliphatic groups contain 1-50 aliphatic carbon atoms. Unless otherwise specified, aliphatic groups contain 1-10 aliphatic carbon atoms. In some embodiments, aliphatic groups contain 1-6 aliphatic carbon atoms. In some embodiments, aliphatic groups contain 1-5 aliphatic carbon atoms. In other embodiments, aliphatic groups contain 1-4 aliphatic carbon atoms. In still other embodiments, aliphatic groups contain 1-3 aliphatic carbon atoms, and in yet other embodiments, aliphatic groups contain 1-2 aliphatic carbon atoms. In some embodiments, "cycloaliphatic" (or "carbocycle" or "cycloalkyl") refers to a monocyclic or bicyclic $C_3$-$C_{10}$ hydrocarbon that is completely saturated or that contains one or more units of unsaturation, but which is not aromatic, that has a single point of attachment to the rest of the molecule. In some embodiments, "cycloaliphatic" (or "carbocycle" or "cycloalkyl") refers to a monocyclic $C_3$-$C_6$ hydrocarbon that is completely saturated or that contains one or more units of unsaturation, but which is not aromatic, that has a single point of attachment to the rest of the molecule. Suitable aliphatic groups include, but are not limited to, linear or branched, substituted or unsubstituted alkyl, alkenyl, alkynyl groups and hybrids thereof such as (cycloalkyl)alkyl, (cycloalkenyl)alkyl or (cycloalkyl)alkenyl.

Alkylene: The term "alkylene" refers to a bivalent alkyl group. An "alkylene chain" is a polymethylene group, i.e., $-(CH_2)_n-$, wherein n is a positive integer, preferably from 1 to 6, from 1 to 4, from 1 to 3, from 1 to 2, or from 2 to 3. A substituted alkylene chain is a polymethylene group in which one or more methylene hydrogen atoms are replaced with a substituent. Suitable substituents include those described below for a substituted aliphatic group.

Alkenylene: The term "alkenylene" refers to a bivalent alkenyl group. A substituted alkenylene chain is a polymethylene group containing at least one double bond in which one or more hydrogen atoms are replaced with a substituent. Suitable substituents include those described below for a substituted aliphatic group.

Animal. As used herein, the term "animal" refers to any member of the animal kingdom. In some embodiments, "animal" refers to humans, at any stage of development. In some embodiments, "animal" refers to non-human animals, at any stage of development. In certain embodiments, the non-human animal is a mammal (e.g., a rodent, a mouse, a rat, a rabbit, a monkey, a dog, a cat, a sheep, cattle, a primate, and/or a pig). In some embodiments, animals include, but are not limited to, mammals, birds, reptiles, amphibians, fish, and/or worms. In some embodiments, an animal may be a transgenic animal, a genetically-engineered animal, and/or a clone.

Approximately: As used herein, the terms "approximately" or "about" in reference to a number are generally taken to include numbers that fall within a range of 5%, 10%, 15%, or 20% in either direction (greater than or less than) of the number unless otherwise stated or otherwise evident from the context (except where such number would be less than 0% or exceed 100% of a possible value). In some embodiments, use of the term "about" in reference to dosages means ±5 mg/kg/day.

Aryl: The term "aryl" used alone or as part of a larger moiety as in "aralkyl," "aralkoxy," or "aryloxyalkyl," refers to monocyclic and bicyclic ring systems having a total of five to fourteen ring members, wherein at least one ring in the system is aromatic and wherein each ring in the system contains three to seven ring members. The term "aryl" may be used interchangeably with the term "aryl ring." In certain embodiments of the present invention, "aryl" refers to an aromatic ring system which includes, but not limited to, phenyl, biphenyl, naphthyl, anthracyl and the like, which may bear one or more substituents. Also included within the scope of the term "aryl," as it is used herein, is a group in which an aromatic ring is fused to one or more non-aromatic rings, such as indanyl, phthalimidyl, naphthimidyl, phenanthridinyl, or tetrahydronaphthyl, and the like.

Characteristic portion: As used herein, the phrase a "characteristic portion" of a protein or polypeptide is one that contains a continuous stretch of amino acids, or a collection of continuous stretches of amino acids, that together are characteristic of a protein or polypeptide. Each such continuous stretch generally will contain at least two amino acids. Furthermore, those of ordinary skill in the art will appreciate that typically at least 5, 10, 15, 20 or more amino acids are required to be characteristic of a protein. In general, a characteristic portion is one that, in addition to the sequence identity specified above, shares at least one functional characteristic with the relevant intact protein.

Characteristic sequence: A "characteristic sequence" is a sequence that is found in all members of a family of polypeptides or nucleic acids, and therefore can be used by those of ordinary skill in the art to define members of the family.

Characteristic structural element: The term "characteristic structural element" refers to a distinctive structural element (e.g., core structure, collection of pendant moieties, sequence element, etc) that is found in all members of a family of polypeptides, small molecules, or nucleic acids, and therefore can be used by those of ordinary skill in the art to define members of the family.

Comparable: The term "comparable" is used herein to describe two (or more) sets of conditions or circumstances that are sufficiently similar to one another to permit comparison of results obtained or phenomena observed. In some embodiments, comparable sets of conditions or circumstances are characterized by a plurality of substantially identical features and one or a small number of varied features. Those of ordinary skill in the art will appreciate that sets of conditions are comparable to one another when characterized by a sufficient number and type of substantially identical features to warrant a reasonable conclusion that differences in results obtained or phenomena observed under the different sets of conditions or circumstances are caused by or indicative of the variation in those features that are varied.

Dosing regimen: As used herein, a "dosing regimen" or "therapeutic regimen" refers to a set of unit doses (typically more than one) that are administered individually to a subject, typically separated by periods of time. In some embodiments, a given therapeutic agent has a recommended dosing regimen, which may involve one or more doses. In some embodiments, a dosing regimen comprises a plurality of doses each of which are separated from one another by a time period of the same length; in some embodiments, a dosing regime comprises a plurality of doses and at least two different time periods separating individual doses. In some embodiments, all doses within a dosing regimen are of the same unit dose amount. In some embodiments, different doses within a dosing regimen are of different amounts. In some embodiments, a dosing regimen comprises a first dose in a first dose amount, followed by one or more additional doses in a second dose amount different from the first dose amount. In some embodiments, a dosing regimen comprises a first dose in a first dose amount, followed by one or more additional doses in a second dose amount same as the first dose amount.

Equivalent agents. Those of ordinary skill in the art, reading the present disclosure, will appreciate that the scope of useful agents in the context of the present invention is not limited to those specifically mentioned or exemplified herein. In particular, those skilled in the art will recognize that active agents typically have a structure that consists of a core and attached pendant moieties, and furthermore will appreciate that simple variations of such core and/or pendant moieties may not significantly alter activity of the agent. For example, in some embodiments, substitution of one or more pendant moieties with groups of comparable three-dimensional structure and/or chemical reactivity characteristics may generate a substituted compound or portion equivalent to a parent reference compound or portion. In some embodiments, addition or removal of one or more pendant moieties may generate a substituted compound equivalent to a parent reference compound. In some embodiments, alteration of core structure, for example by addition or removal of a small number of bonds (typically not more than 5, 4, 3, 2, or 1 bonds, and often only a single bond) may generate a substituted compound equivalent to a parent reference compound. In many embodiments, equivalent compounds may be prepared by methods illustrated in general reaction schemes as, for example, described below, or by modifications thereof, using readily available starting materials, reagents and conventional or provided synthesis procedures. In these reactions, it is also possible to make use of variants, which are in themselves known, but are not mentioned here.

Equivalent Dosage: The term "equivalent dosage" is used herein to compare dosages of different pharmaceutically active agents that effect the same biological result. Dosages of two different agents are considered to be "equivalent" to one another in accordance with the present invention if they achieve a comparable level or extent of the biological result. In some embodiments, equivalent dosages of different pharmaceutical agents for use in accordance with the present invention are determined using in vitro and/or in vivo assays as described herein. In some embodiments, one or more lysosomal activating agents for use in accordance with the present invention is utilized at a dose equivalent to a dose of a reference lysosomal activating agent; in some such embodiments, the reference lysosomal activating agent for such purpose is selected from the group consisting of small molecule allosteric activators (e.g., pyrazolpyrimidines), imminosugars (e.g., isofagomine), antioxidants (e.g., n-acetyl-cysteine), and regulators of cellular trafficking (e.g., Rabla polypeptide).

Heteroaliphatic: The term "heteroaliphatic" refers to an aliphatic group wherein one or more units selected from C, CH, $CH_2$, or $CH_3$ are independently replaced by a heteroatom. In some embodiments, a heteroaliphatic group is heteroalkyl. In some embodiments, a heteroaliphatic group is heteroalkenyl.

Heteroaryl: The terms "heteroaryl" and "heteroar-," used alone or as part of a larger moiety, e.g., "heteroaralkyl," or "heteroaralkoxy," refer to groups having 5 to 10 ring atoms, preferably 5, 6, or 9 ring atoms; having 6, 10, or 14 $\pi$ electrons shared in a cyclic array; and having, in addition to carbon atoms, from one to five heteroatoms. The term "heteroatom" refers to nitrogen, oxygen, or sulfur, and includes any oxidized form of nitrogen or sulfur, and any quaternized form of a basic nitrogen. Heteroaryl groups include, without limitation, thienyl, furanyl, pyrrolyl, imidazolyl, pyrazolyl, triazolyl, tetrazolyl, oxazolyl, isoxazolyl, oxadiazolyl, thiazolyl, isothiazolyl, thiadiazolyl, pyridyl, pyridazinyl, pyrimidinyl, pyrazinyl, indolizinyl, purinyl, naphthyridinyl, and pteridinyl. The terms "heteroaryl" and "heteroar-," as used herein, also include groups in which a heteroaromatic ring is fused to one or more aryl, cycloaliphatic, or heterocyclyl rings, where the radical or point of attachment is on the heteroaromatic ring. Nonlimiting examples include indolyl, isoindolyl, benzothienyl, benzofuranyl, dibenzofuranyl, indazolyl, benzimidazolyl, benzthiazolyl, quinolyl, isoquinolyl, cinnolinyl, phthalazinyl, quinazolinyl, quinoxalinyl, 4H-quinolizinyl, carbazolyl, acridinyl, phenazinyl, phenothiazinyl, phenoxazinyl, tetrahydroquinolinyl, tetrahydroisoquinolinyl, and pyrido[2,3-b]-1,4-oxazin-3(4H)-one. A heteroaryl group may be mono- or bicyclic. The term "heteroaryl" may be used interchangeably with the terms "heteroaryl ring," "heteroaryl group," or "heteroaromatic," any of which terms include rings that are optionally substituted. The term "heteroaralkyl" refers to an alkyl group substituted by a heteroaryl, wherein the alkyl and heteroaryl portions independently are optionally substituted.

Heteroatom: The term "heteroatom" means one or more of oxygen, sulfur, nitrogen, phosphorus, or silicon (including, any oxidized form of nitrogen, sulfur, phosphorus, or silicon; the quaternized form of any basic nitrogen or; a substitutable nitrogen of a heterocyclic ring, for example N (as in 3,4-dihydro-2H-pyrrolyl), NH (as in pyrrolidinyl) or $NR^+$ (as in N-substituted pyrrolidinyl)).

Heterocycle: As used herein, the terms "heterocycle," "heterocyclyl," "heterocyclic radical," and "heterocyclic ring" are used interchangeably and refer to a stable 3- to 7-membered monocyclic or 7-10-membered bicyclic heterocyclic moiety that is either saturated or partially unsaturated, and having, in addition to carbon atoms, one or more, preferably one to four, heteroatoms, as defined above. When used in reference to a ring atom of a heterocycle, the term "nitrogen" includes a substituted nitrogen. As an example, in a saturated or partially unsaturated ring having 0-3 heteroatoms selected from oxygen, sulfur or nitrogen, the nitrogen may be N (as in 3,4-dihydro-2H-pyrrolyl), NH (as in pyrrolidinyl), or +NR (as in N-substituted pyrrolidinyl).

A heterocyclic ring can be attached to its pendant group at any heteroatom or carbon atom that results in a stable structure and any of the ring atoms can be optionally substituted. Examples of such saturated or partially unsaturated heterocyclic radicals include, without limitation, tetrahydrofuranyl, tetrahydrothiophenyl pyrrolidinyl, piperidinyl, pyrrolinyl, tetrahydroquinolinyl, tetrahydroisoquinolinyl, decahydroquinolinyl, oxazolidinyl, piperazinyl, dioxanyl, dioxolanyl, diazepinyl, oxazepinyl, thiazepinyl, morpholinyl, and quinuclidinyl. The terms "heterocycle," "heterocyclyl," "heterocyclyl ring," "heterocyclic group," "heterocyclic moiety," and "heterocyclic radical," are used interchangeably herein, and also include groups in which a heterocyclyl ring is fused to one or more aryl, heteroaryl, or cycloaliphatic rings, such as indolinyl, 3H-indolyl, chromanyl, phenanthridinyl, or tetrahydroquinolinyl, where the radical or point of attachment is on the heterocyclyl ring. A heterocyclyl group may be mono- or bicyclic. The term "heterocyclylalkyl" refers to an alkyl group substituted by a heterocyclyl, wherein the alkyl and heterocyclyl portions independently are optionally substituted.

Intraperitoneal: The phrases "intraperitoneal administration" and "administered intraperitonealy" as used herein have their art-understood meaning referring to administration of a compound or composition into the peritoneum of a subject.

In vitro: As used herein, the term "in vitro" refers to events that occur in an artificial environment, e.g., in a test tube or reaction vessel, in cell culture, etc., rather than within an organism (e.g., animal, plant, and/or microbe).

In vivo: As used herein, the term "in vivo" refers to events that occur within an organism (e.g., animal, plant, and/or microbe).

Lower alkyl: The term "lower alkyl" refers to a $C_{1-4}$ straight or branched alkyl group. Exemplary lower alkyl groups are methyl, ethyl, propyl, isopropyl, butyl, isobutyl, and tert-butyl.

Lower haloalkyl: The term "lower haloalkyl" refers to a $C_{1-4}$ straight or branched alkyl group that is substituted with one or more halogen atoms.

Optionally substituted. As described herein, compounds of the invention may contain "optionally substituted" moieties. In general, the term "substituted," whether preceded by the term "optionally" or not, means that one or more hydrogens of the designated moiety are replaced with a suitable substituent. Unless otherwise indicated, an "optionally substituted" group may have a suitable substituent at each substitutable position of the group, and when more than one position in any given structure may be substituted with more than one substituent selected from a specified group, the substituent may be either the same or different at every position. Combinations of substituents envisioned by this invention are preferably those that result in the formation of stable or chemically feasible compounds. The term "stable," as used herein, refers to compounds that are not substantially altered when subjected to conditions to allow for their production, detection, and, in certain embodiments, their recovery, purification, and use for one or more of the purposes disclosed herein.

Suitable monovalent substituents on a substitutable carbon atom of an "optionally substituted" group are independently halogen; —$(CH_2)_{0-4}R°$; —$(CH_2)_{0-4}OR°$; —$O(CH_2)_{0-4}R°$, —O—$(CH_2)_{0-4}C(O)OR°$; —$(CH_2)_{0-4}CH(OR°)_2$; —$(CH_2)_{0-4}SR°$; —$(CH_2)_{0-4}Ph$, which may be substituted with $R°$; —$(CH_2)_{0-4}O(CH_2)_{0-4}Ph$ which may be substituted with $R°$; —CH=CHPh, which may be substituted with $R°$; —$(CH_2)_{0-4}O(CH_2)_{0-1}$-pyridyl which may be substituted with $R°$; —$NO_2$; —CN; —$N_3$; —$(CH_2)_{0-4}N(R°)_2$; —$(CH_2)_{0-4}N(R°)C(O)R°$; —$N(R°)C(S)R°$; —$(CH_2)_{0-4}N(R°)C(O)NR°_2$; —$N(R°)C(S)NR°_2$; —$(CH_2)_{0-4}N(R°)C(O)OR°$; —$N(R°)N(R°)C(O)R°$; —$N(R°)N(R°)C(O)NR°_2$; —$N(R°)N(R°)C(O)OR°$; —$(CH_2)_{0-4}C(O)R°$; —$C(S)R°$; —$(CH_2)_{0-4}C(O)OR°$; —$(CH_2)_{0-4}C(O)SR°$; —$(CH_2)AC(O)OSiR°_3$; —$(CH_2)_{0-4}OC(O)R°$; —OC(O)$(CH_2)_{0-4}SR$—, SC(S)SR°; —$(CH_2)_{0-4}SC(O)R°$; —$(CH_2)_{0-4}C(O)NR°_2$; —$C(S)NR°_2$; —$C(S)SR°$; —$SC(S)SR°$, —$(CH_2)_{0-4}C(O)NR°_2$; —$C(O)N(OR°)R°$; —$C(O)C(O)R°$; —$C(O)CH_2C(O)R°$; —$C(NOR°)R°$; —$(CH_2)_{0-4}SSR°$; —$(CH_2)_{0-4}S(O)_2R°$; —$(CH_2)_{0-4}S(O)_2OR°$; —$(CH_2)_{0-4}OS(O)_2R°$; —$S(O)_2 NR°_2$; —$(CH_2)_{0-4}S(O)R°$; —$N(R°)S(O)_2NR°_2$; —$N(R°)S(O)_2R°$; —$N(OR°)R°$; —$C(NH)NR°_2$; —$P(O)_2R°$; —$P(O)R°_2$; —$OP(O)R°_2$; —$OP(O)(OR°)_2$; —$SiR°_3$; —$(C_{1-4}$ straight or branched alkylene)O—$N(R°)_2$; or —$(C_{1-4}$ straight or branched alkylene)C(O)O—$N(R°)_2$, wherein each $R°$ may be substituted as defined below and is independently hydrogen, $C_{1-6}$ aliphatic, —$CH_2Ph$, —$O(CH_2)_{0-1}$ Ph, —$CH_2$-(5-6 membered heteroaryl ring), or a 5-6-membered saturated, partially unsaturated, or aryl ring having 0-4 heteroatoms independently selected from nitrogen, oxygen, or sulfur, or, notwithstanding the definition above, two independent occurrences of R°, taken together with their intervening atom(s), form a 3-12-membered saturated, partially unsaturated, or aryl mono- or bicyclic ring having 0-4 heteroatoms independently selected from nitrogen, oxygen, or sulfur, which may be substituted as defined below.

Suitable monovalent substituents on R° (or the ring formed by taking two independent occurrences of R° together with their intervening atoms), are independently halogen, —(CH$_2$)$_{0-2}$R$^●$, -(haloR$^●$), —(CH$_2$)$_{0-2}$OH, —(CH$_2$)$_{0-2}$OR', —(CH$_2$)$_{0-2}$CH(OR$^●$)$_2$; —O(haloR$^●$), —CN, —N$_3$, —(CH$_2$)$_{0-2}$C(O)R$^●$, —(CH$_2$)$_{0-2}$C(O)OH, —(CH$_2$)$_{0-2}$C(O)OR$^●$, —(CH$_2$)$_{0-2}$SR$^●$, —(CH$_2$)$_{0-2}$SH, —(CH$_2$)$_{0-2}$NH$_2$, —(CH$_2$)$_{0-2}$NHR$^●$, —(CH$_2$)$_{0-2}$NR$_2$, —NO$_2$, —SiR$^●_3$, —OSiR$^●_3$, —C(O)SR, —(C$_{1-4}$ straight or branched alkylene)C(O)OR$^●$, or —SSR° wherein each R$^●$ is unsubstituted or where preceded by "halo" is substituted only with one or more halogens, and is independently selected from C$_{1-4}$ aliphatic, —CH$_2$Ph, —O(CH$_2$)$_{0-1}$Ph, or a 5-6-membered saturated, partially unsaturated, or aryl ring having 0-4 heteroatoms independently selected from nitrogen, oxygen, or sulfur. Suitable divalent substituents on a saturated carbon atom of R° include =O and =S.

Suitable divalent substituents on a saturated carbon atom of an "optionally substituted" group include the following: =O, =S, =NNR*$_2$, =NNHC(O)R*, =NNHC(O)OR*, =NNHS(O)$_2$R*, =NR*, =NOR*, —O(C(R*$_2$))$_{2-3}$O—, or —S(C(R*$_2$))$_{2-3}$S—, wherein each independent occurrence of R* is selected from hydrogen, C$_{1-6}$ aliphatic which may be substituted as defined below, or an unsubstituted 5-6-membered saturated, partially unsaturated, or aryl ring having 0-4 heteroatoms independently selected from nitrogen, oxygen, or sulfur. Suitable divalent substituents that are bound to vicinal substitutable carbons of an "optionally substituted" group include: —O(CR*$_2$)$_{2-3}$O—, wherein each independent occurrence of R* is selected from hydrogen, C$_{1-6}$ aliphatic which may be substituted as defined below, or an unsubstituted 5-6-membered saturated, partially unsaturated, or aryl ring having 0-4 heteroatoms independently selected from nitrogen, oxygen, or sulfur.

Suitable substituents on the aliphatic group of R* include halogen, —R$^●$, -(haloR$^●$), —OH, —OR$^●$, —O(haloR$^●$), —CN, —C(O)OH, —C(O)OR$^●$, —NH$_2$, —NHR$^●$, —NR$^●_2$, or —NO$_2$, wherein each R$^●$ is unsubstituted or where preceded by "halo" is substituted only with one or more halogens, and is independently C$_{1-4}$ aliphatic, —CH$_2$Ph, —O(CH$_2$)$_{0-1}$Ph, or a 5-6-membered saturated, partially unsaturated, or aryl ring having 0-4 heteroatoms independently selected from nitrogen, oxygen, or sulfur.

Suitable substituents on a substitutable nitrogen of an "optionally substituted" group include —R$^†$, —NR$^†_2$, —C(O)R$^†$, —C(O)OR$^†$, —C(O)C(O)R$^†$, —C(O)CH$_2$C(O)R$^†$, —S(O)$_2$R$^†$, —S(O)$_2$NR$^†_2$, —C(S)NR$^†_2$, —C(NH)NR$^{†2}$, or —N(R$^†$)S(O)$_2$R$^†$; wherein each R$^†$ is independently hydrogen, C$_{1-6}$ aliphatic which may be substituted as defined below, unsubstituted —OPh, or an unsubstituted 5-6-membered saturated, partially unsaturated, or aryl ring having 0-4 heteroatoms independently selected from nitrogen, oxygen, or sulfur, or, notwithstanding the definition above, two independent occurrences of R$^†$, taken together with their intervening atom(s) form an unsubstituted 3-12-membered saturated, partially unsaturated, or aryl mono- or bicyclic ring having 0-4 heteroatoms independently selected from nitrogen, oxygen, or sulfur.

Suitable substituents on the aliphatic group of R$^†$ are independently halogen, —R$^●$, -(haloR$^●$), —OH, —OR$^●$, —O(haloR$^●$), —CN, —C(O)OH, —C(O)OR$^●$, —NH$_2$, —NHR, —NR$^●_2$, or —NO$_2$, wherein each R$^●$ is unsubstituted or where preceded by "halo" is substituted only with one or more halogens, and is independently C$_{1-4}$ aliphatic, —CH$_2$Ph, —O(CH$_2$)$_{0-1}$-Ph, or a 5-6-membered saturated, partially unsaturated, or aryl ring having 0-4 heteroatoms independently selected from nitrogen, oxygen, or sulfur.

Oral: The phrases "oral administration" and "administered orally" as used herein have their art-understood meaning referring to administration by mouth of a compound or composition.

Parenteral: The phrases "parenteral administration" and "administered parenterally" as used herein have their art-understood meaning referring to modes of administration other than enteral and topical administration, usually by injection, and include, without limitation, intravenous, intramuscular, intraarterial, intrathecal, intracapsular, intraorbital, intracardiac, intradermal, intraperitoneal, transtracheal, subcutaneous, subcuticular, intraarticulare, subcapsular, subarachnoid, intraspinal, and intrasternal injection and infusion.

Partially unsaturated: As used herein, the term "partially unsaturated" refers to a ring moiety that includes at least one double or triple bond. The term "partially unsaturated" is intended to encompass rings having multiple sites of unsaturation, but is not intended to include aryl or heteroaryl moieties, as herein defined.

Pharmaceutical composition: As used herein, the term "pharmaceutical composition" refers to an active agent, formulated together with one or more pharmaceutically acceptable carriers. In some embodiments, active agent is present in unit dose amount appropriate for administration in a therapeutic regimen that shows a statistically significant probability of achieving a predetermined therapeutic effect when administered to a relevant population. In some embodiments, pharmaceutical compositions may be specially formulated for administration in solid or liquid form, including those adapted for the following: oral administration, for example, drenches (aqueous or non-aqueous solutions or suspensions), tablets, e.g., those targeted for buccal, sublingual, and systemic absorption, boluses, powders, granules, pastes for application to the tongue; parenteral administration, for example, by subcutaneous, intramuscular, intravenous or epidural injection as, for example, a sterile solution or suspension, or sustained-release formulation; topical application, for example, as a cream, ointment, or a controlled-release patch or spray applied to the skin, lungs, or oral cavity; intravaginally or intrarectally, for example, as a pessary, cream, or foam; sublingually; ocularly; transdermally; or nasally, pulmonary, and to other mucosal surfaces.

Pharmaceutically acceptable: As used herein, the phrase "pharmaceutically acceptable" refers to those compounds, materials, compositions, and/or dosage forms which are, within the scope of sound medical judgment, suitable for use in contact with the tissues of human beings and animals without excessive toxicity, irritation, allergic response, or other problem or complication, commensurate with a reasonable benefit/risk ratio.

Pharmaceutically acceptable carrier: As used herein, the term "pharmaceutically acceptable carrier" means a pharmaceutically-acceptable material, composition or vehicle, such as a liquid or solid filler, diluent, excipient, or solvent encapsulating material, involved in carrying or transporting the subject compound from one organ, or portion of the body, to another organ, or portion of the body. Each carrier must be "acceptable" in the sense of being compatible with the other ingredients of the formulation and not injurious to the patient. Some examples of materials which can serve as pharmaceutically-acceptable carriers include: sugars, such as lactose, glucose and sucrose; starches, such as corn starch and potato starch; cellulose, and its derivatives, such as sodium carboxymethyl cellulose, ethyl cellulose and cellulose acetate; powdered tragacanth; malt; gelatin; talc; excipients, such as cocoa butter and suppository waxes; oils, such as peanut oil, cottonseed oil, safflower oil, sesame oil, olive oil, corn oil and soybean oil; glycols, such as propylene glycol; polyols, such as glycerin, sorbitol, mannitol and polyethylene glycol; esters, such as ethyl oleate and ethyl laurate; agar; buffering agents, such as magnesium hydroxide and aluminum hydroxide; alginic acid; pyrogen-free water; isotonic saline; Ringer's solution; ethyl alcohol; pH buffered solutions; polyesters, polycarbonates and/or polyanhydrides; and other non-toxic compatible substances employed in pharmaceutical formulations.

Pharmaceutically acceptable salt: The term "pharmaceutically acceptable salt", as used herein, refers to salts of such compounds that are appropriate for use in pharmaceutical contexts, i.e., salts which are, within the scope of sound medical judgment, suitable for use in contact with the tissues of humans and lower animals without undue toxicity, irritation, allergic response and the like, and are commensurate with a reasonable benefit/risk ratio. Pharmaceutically acceptable salts are well known in the art. For example, S. M. Berge, et al. describes pharmaceutically acceptable salts in detail in J. Pharmaceutical Sciences, 66: 1-19 (1977). In some embodiments, pharmaceutically acceptable salt include, but are not limited to, nontoxic acid addition salts, which are salts of an amino group formed with inorganic acids such as hydrochloric acid, hydrobromic acid, phosphoric acid, sulfuric acid and perchloric acid or with organic acids such as acetic acid, maleic acid, tartaric acid, citric acid, succinic acid or malonic acid or by using other methods used in the art such as ion exchange. In some embodiments, pharmaceutically acceptable salts include, but are not limited to, adipate, alginate, ascorbate, aspartate, benzenesulfonate, benzoate, bisulfate, borate, butyrate, camphorate, camphorsulfonate, citrate, cyclopentanepropionate, digluconate, dodecylsulfate, ethanesulfonate, formate, fumarate, glucoheptonate, glycerophosphate, gluconate, hemisulfate, heptanoate, hexanoate, hydroiodide, 2-hydroxy-ethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, p-toluenesulfonate, undecanoate, valerate salts, and the like. Representative alkali or alkaline earth metal salts include sodium, lithium, potassium, calcium, magnesium, and the like. In some embodiments, pharmaceutically acceptable salts include, when appropriate, nontoxic ammonium, quaternary ammonium, and amine cations formed using counterions such as halide, hydroxide, carboxylate, sulfate, phosphate, nitrate, alkyl having from 1 to 6 carbon atoms, sulfonate and aryl sulfonate.

Prodrug: A general, a "prodrug," as that term is used herein and as is understood in the art, is an entity that, when administered to an organism, is metabolized in the body to deliver an active (e.g., therapeutic or diagnostic) agent of interest. Typically, such metabolism involves removal of at least one "prodrug moiety" so that the active agent is formed. Various forms of "prodrugs" are known in the art.

For examples of such prodrug moieties, see:
a) *Design of Prodrugs*, edited by H. Bundgaard, (Elsevier, 1985) and *Methods in Enzymology*, 42:309-396, edited by K. Widder, et al. (Academic Press, 1985);
b) *Prodrugs and Targeted Delivery*, edited by by J. Rautio (Wiley, 2011);
c) *Prodrugs and Targeted Delivery*, edited by by J. Rautio (Wiley, 2011);
d) *A Textbook of Drug Design and Development*, edited by Krogsgaard-Larsen;
e) Bundgaard, Chapter 5 "Design and Application of Prodrugs", by H. Bundgaard, p. 113-191 (1991);
f) Bundgaard, *Advanced Drug Delivery Reviews*, 8:1-38 (1992);
g) Bundgaard, et al., *Journal of Pharmaceutical Sciences*, 77:285 (1988); and
h) Kakeya, et al., *Chem. Pharm. Bull.*, 32:692 (1984).

As with other compounds described herein, prodrugs may be provided in any of a variety of forms, e.g., crystal forms, salt forms etc. In some embodiments, prodrugs are provided as pharmaceutically acceptable salts thereof.

Protecting group: The term "protecting group," as used herein, is well known in the art and includes those described in detail in *Protecting Groups in Organic Synthesis*, T. W. Greene and P. G. M. Wuts, $3^{rd}$ edition, John Wiley & Sons, 1999, the entirety of which is incorporated herein by reference. Also included are those protecting groups specially adapted for nucleoside and nucleotide chemistry described in *Current Protocols in Nucleic Acid Chemistry*, edited by Serge L. Beaucage et al. June 2012, the entirety of Chapter 2 is incorporated herein by reference. Suitable amino-protecting groups include methyl carbamate, ethyl carbamante, 9-fluorenylmethyl carbamate (Fmoc), 9-(2-sulfo)fluorenylmethyl carbamate, 9-(2,7-dibromo)fluoroenylmethyl carbamate, 2,7-di-t-butyl-[9-(10,10-dioxo-10,10,10,10-tetrahydrothioxanthyl)]methyl carbamate (DBD-Tmoc), 4-methoxyphenacyl carbamate (Phenoc), 2,2,2-trichloroethyl carbamate (Troc), 2-trimethylsilylethyl carbamate (Teoc), 2-phenylethyl carbamate (hZ), 1-(1-adamantyl)-1-methylethyl carbamate (Adpoc), 1,1-dimethyl-2-haloethyl carbamate, 1,1-dimethyl-2,2-dibromoethyl carbamate (DB-t-BOC), 1,1-dimethyl-2,2,2-trichloroethyl carbamate (TCBOC), 1-methyl-1-(4-biphenylyl)ethyl carbamate (Bpoc), 1-(3,5-di-t-butylphenyl)-1-methylethyl carbamate (t-Bumeoc), 2-(2'- and 4'-pyridyl)ethyl carbamate (Pyoc), 2-(N,N-dicyclohexylcarboxamido)ethyl carbamate, t-butyl carbamate (BOC), 1-adamantyl carbamate (Adoc), vinyl carbamate (Voc), allyl carbamate (Alloc), 1-isopropylallyl carbamate (Ipaoc), cinnamyl carbamate (Coc), 4-nitrocinnamyl carbamate (Noc), 8-quinolyl carbamate, N-hydroxypiperidinyl carbamate, alkyldithio carbamate, benzyl carbamate (Cbz), p-methoxybenzyl carbamate (Moz), p-nitobenzyl carbamate, p-bromobenzyl carbamate, p-chlorobenzyl carbamate, 2,4-dichlorobenzyl carbamate, 4-methylsulfinylbenzyl carbamate (Msz), 9-anthrylmethyl carbamate, diphenylmethyl carbamate, 2-methylthioethyl carbamate, 2-methyl sulfonyl ethyl carbamate, 2-(p-toluenesulfonyl)ethyl carbamate, [2-(1,3-dithianyl)]methyl carbamate (Dmoc), 4-methylthiophenyl carbamate (Mtpc), 2,4-dimethylthiophenyl carbamate (Bmpc), 2-phosphonioethyl carbamate (Peoc), 2-triphenylphosphonioisopropyl carbamate (Ppoc), 1,1-dimethyl-2-cyanoethyl carbamate, m-chloro-p-acyloxybenzyl carbamate, p-(dihydroxyboryl)benzyl carbamate, 5-benzisoxazolylmethyl carbamate, 2-(trifluoromethyl)-6-chromonylmethyl carbamate (Tcroc), m-nitrophenyl carbamate, 3,5-dimethoxybenzyl carbamate, o-nitrobenzyl carbamate, 3,4-dimethoxy-6-nitrobenzyl carbamate, phenyl(o-nitrophenyl)methyl carbamate, phenothiazinyl-(10)-carbonyl derivative, N'-p-toluenesulfonylaminocarbonyl derivative, N'-phenylaminothiocarbonyl derivative, t-amyl carbamate, S-benzyl thiocarbamate, p-cyanobenzyl carbamate, cyclobutyl carbamate, cyclohexyl carbamate, cyclopentyl carbamate, cyclopropylmethyl carbamate, p-decyloxybenzyl carbamate, 2,2-dimethoxycarbonylvinyl carbamate, o-(N,N-dimethylcarboxamido)benzyl carbamate, 1,1-di methyl-3-(N,N-dimethylcarboxamido) propyl carbamate, 1,1-dimethylpropynyl carbamate, di(2-pyridyl)methyl carbamate, 2-furanylmethyl carbamate, 2-iodoethyl carbamate, isobornyl carbamate, isobutyl carbamate, isonicotinyl carbamate, p-(p'-methoxyphenylazo) benzyl carbamate, 1-methylcyclobutyl carbamate, 1-methylcyclohexyl carbamate, 1-methyl-1-cyclopropylmethyl carbamate, 1-methyl-1-(3,5-dimethoxyphenyl)ethyl carbamate, 1-methyl-1-(p-phenylazophenyl)ethyl carbamate, 1-methyl-1-phenylethyl carbamate, 1-methyl-1-(4-pyridyl) ethyl carbamate, phenyl carbamate, p-(phenylazo)benzyl carbamate, 2,4,6-tri-t-butylphenyl carbamate, 4-(trimethylammonium)benzyl carbamate, 2,4,6-trimethylbenzyl carbamate, formamide, acetamide, chloroacetamide, trichloroacetamide, trifluoroacetamide, phenylacetamide, 3-phenylpropanamide, picolinamide, 3-pyridylcarboxamide, N-benzoylphenylalanyl derivative, benzamide, p-phenylbenzamide, o-nitophenylacetamide, o-nitrophenoxyacetamide, acetoacetamide, (N'-dithiobenzyloxycarbonylamino) acetamide, 3-(p-hydroxyphenyl)propanamide, 3-(o-nitrophenyl)propanamide, 2-methyl-2-(o-nitrophenoxy) propanamide, 2-methyl-2-(o-phenylazophenoxy) propanamide, 4-chlorobutanamide, 3-methyl-3-nitrobutanamide, o-nitrocinnamide, N-acetylmethionine derivative, o-nitrobenzamide, o-(benzoyloxymethyl)benzamide, 4,5-diphenyl-3-oxazolin-2-one, N-phthalimide, N-dithiasuccinimide (Dts), N-2,3-diphenylmaleimide, N-2,5-dimethylpyrrole, N-1,1,4,4-tetramethyldisilylazacyclopentane adduct (STABASE), 5-substituted 1,3-dimethyl-1,3,5-triazacyclohexan-2-one, 5-substituted 1,3-dibenzyl-1,3,5-triazacyclohexan-2-one, 1-substituted 3,5-dinitro-4-pyridone, N-methylamine, N-allylamine, N-[2-(trimethylsilyl)ethoxy]methylamine (SEM), N-3-acetoxypropylamine, N-(1-isopropyl-4-nitro-2-oxo-3-pyroolin-3-yl)amine, quaternary ammonium salts, N-benzylamine, N-di(4-methoxyphenyl)methylamine, N-5-dibenzosuberylamine, N-triphenylmethyl amine (Tr), N-[(4-methoxyphenyl)diphenylmethyl]amine (MMTr), N-9-phenylfluorenylamine (PhF), N-2,7-dichloro-9-fluorenylmethyleneamine, N-ferrocenylmethylamino (Fcm), N-2-picolylamino N'-oxide, N-1,1-dimethylthiomethyleneamine, N-benzylideneamine, N-p-methoxybenzylideneamine, N-diphenylmethyleneamine, N-[(2-pyridyl)mesityl]methyleneamine, N—(N',N'-dimethylaminomethylene) amine, N,N'-isopropylidenediamine, N-p-nitrobenzylideneamine, N-salicylideneamine, N-5-chlorosalicylideneamine, N-(5-chloro-2-hydroxyphenyl) phenylmethyleneamine, N-cyclohexylideneamine, N-(5,5-dimethyl-3-oxo-1-cyclohexenyl)amine, N-borane derivative, N-diphenylborinic acid derivative, N-[phenyl (pentacarbonylchromium- or tungsten)carbonyl]amine, N-copper chelate, N-zinc chelate, N-nitroamine, N-nitrosoamine, amine N-oxide, diphenylphosphinamide (Dpp), dimethylthiophosphinamide (Mpt), diphenylthiophosphinamide (Ppt), dialkyl phosphoramidates, dibenzyl phosphoramidate, diphenyl phosphorami date, benzenesulfenamide, o-nitrobenzenesulfenamide (Nps), 2,4-dinitrobenzenesulfenamide, pentachlorobenzenesulfenamide, 2-nitro-4-methoxybenzenesulfenamide, triphenylmethylsulfenamide, 3-nitropyridinesulfenamide (Npys), p-toluenesulfonamide (Ts), benzenesulfonamide, 2,3,6,-trimethyl-4-methoxybenzenesulfonamide (Mtr), 2,4,6-trimethoxybenzenesulfonamide (Mtb), 2,6-dimethyl-4-methoxybenzenesulfonamide (Pme), 2,3,5,6-tetramethyl-4-methoxybenzenesulfonamide (Mte), 4-methoxybenzenesulfonamide (Mbs), 2,4,6-trimethylbenzenesulfonamide (Mts), 2,6-dimethoxy-4-methylbenzenesulfonamide (iMds), 2,2,5,7,8-pentamethylchroman-6-sulfonamide (Pmc), methanesulfonamide (Ms), β-trimethylsilylethanesulfonamide (SES), 9-anthracenesulfonamide, 4-(4',8'-dimethoxynaphthylmethyl)benzenesulfonamide (DNMBS), benzylsulfonamide, trifluoromethylsulfonamide, and phenacylsulfonamide.

Suitably protected carboxylic acids further include, but are not limited to, silyl-, alkyl-, alkenyl-, aryl-, and arylalkyl-protected carboxylic acids. Examples of suitable silyl groups include trimethylsilyl, triethylsilyl, t-butyldimethylsilyl, t-butyldiphenylsilyl, triisopropylsilyl, and the like. Examples of suitable alkyl groups include methyl, benzyl, p-methoxybenzyl, 3,4-dimethoxybenzyl, trityl, t-butyl, tetrahydropyran-2-yl. Examples of suitable alkenyl groups include allyl. Examples of suitable aryl groups include optionally substituted phenyl, biphenyl, or naphthyl. Examples of suitable arylalkyl groups include optionally substituted benzyl (e.g., p-methoxybenzyl (MPM), 3,4-dimethoxybenzyl, 0-nitrobenzyl, p-nitrobenzyl, p-halobenzyl, 2,6-dichlorobenzyl, p-cyanobenzyl), and 2- and 4-picolyl.

Suitable hydroxyl protecting groups include methyl, methoxylmethyl (MOM), methylthiomethyl (MTM), t-butylthiomethyl, (phenyldimethylsilyl)methoxymethyl (SMOM), benzyloxymethyl (BOM), p-methoxybenzyloxymethyl (PMBM), (4-methoxyphenoxy)methyl (p-AOM), guaiacolmethyl (GUM), t-butoxymethyl, 4-pentenyloxymethyl (POM), siloxymethyl, 2-methoxyethoxymethyl (MEM), 2,2,2-trichl oroethoxymethyl, bis(2-chloroethoxy)methyl, 2-(trimethylsilyl)ethoxymethyl (SEMOR), tetrahydropyranyl (THP), 3-bromotetrahydropyranyl, tetrahydrothiopyranyl, 1-methoxycyclohexyl, 4-methoxytetrahydropyranyl (MTHP), 4-methoxytetrahydrothiopyranyl, 4-methoxytetrahydrothiopyranyl S,S-dioxide, 1-[(2-chloro-4-methyl)phenyl]-4-methoxypiperidin-4-yl (CTMP), 1,4-dioxan-2-yl, tetrahydrofuranyl, tetrahydrothiofuranyl, 2,3,3a,4,5,6,7,7a-octahydro-7,8,8-trimethyl-4,7-methanobenzofuran-2-yl, 1-ethoxyethyl, 1-(2-chloroethoxy)ethyl, 1-methyl-1-methoxyethyl, 1-methyl-1-benzyloxyethyl, 1-methyl-1-benzyl oxy-2-fluoroethyl, 2,2,2-trichloroethyl, 2-trimethylsilyl ethyl, 2-(phenylselenyl) ethyl, t-butyl, allyl, p-chlorophenyl, p-methoxyphenyl, 2,4-dinitrophenyl, benzyl, p-methoxybenzyl, 3,4-dimethoxybenzyl, o-nitrobenzyl, p-nitrobenzyl, p-halobenzyl, 2,6-dichlorobenzyl, p-cyanobenzyl, p-phenylbenzyl, 2-picolyl, 4-picolyl, 3-methyl-2-picolyl N-oxide, diphenylmethyl, p,p'-dinitrobenzhydryl, 5-dibenzosuberyl, triphenylmethyl, α-naphthyldiphenylmethyl, p-methoxyphenyldiphenylmethyl, di(p-methoxyphenyl)phenylmethyl, tri(p-methoxyphenyl)methyl, 4-(4'-bromophenacyloxyphenyl)diphenylmethyl, 4,4',4"-tris(4,5-dichlorophthalimidophenyl)methyl, 4,4',4"-tris(levulinoyloxyphenyl)methyl, 4,4',4"-tris(benzoyloxyphenyl)methyl, 3-(imidazol-1-yl)bis (4,4' '-dimethoxyphenyl)methyl, 1,1-bis(4-methoxyphenyl)-1'-pyrenylmethyl, 9-anthryl, 9-(9-phenyl)xanthenyl, 9-(9-phenyl-10-oxo)anthryl, 1,3-benzodithiolan-2-yl, benzisothiazolyl S,S-dioxido, trimethylsilyl (TMS), triethylsilyl (TES), triisopropylsilyl (TIPS), dimethylisopropylsilyl (IPDMS), diethylisopropylsilyl (DEIPS), dimethylthexylsilyl, t-butyldimethylsilyl (TBDMS), t-butyldiphenylsilyl (TBDPS), tribenzylsilyl, tri-p-xylylsilyl, triphenylsilyl, diphenylmethylsilyl (DPMS), t-butylmethoxyphenylsilyl (TBMPS), formate, benzoylformate, acetate, chloroacetate, dichloroacetate, trichloroacetate, trifluoroacetate, methoxyacetate, triphenylmethoxyacetate, phenoxyacetate, p-chlorophenoxyacetate, 3-phenylpropionate, 4-oxopentanoate (levulinate), 4,4-(ethylenedithio)pentanoate (levulinoyldithioacetal), pivaloate, adamantoate, crotonate, 4-methoxycrotonate, benzoate, p-phenylbenzoate, 2,4,6-trimethylbenzoate (mesitoate), alkyl methyl carbonate, 9-fluorenylmethyl carbonate (Fmoc), alkyl ethyl carbonate, alkyl 2,2,2-trichloroethyl carbonate (Troc), 2-(trimethylsilyl)ethyl carbonate (TMSEC), 2-(phenylsulfonyl) ethyl carbonate (Psec), 2-(triphenylphosphonio) ethyl carbonate (Peoc), alkyl isobutyl carbonate, alkyl vinyl carbonate alkyl allyl carbonate, alkyl p-nitrophenyl carbonate, alkyl benzyl carbonate, alkyl p-methoxybenzyl carbonate, alkyl 3,4-dimethoxybenzyl carbonate, alkyl o-nitrobenzyl carbonate, alkyl p-nitrobenzyl carbonate, alkyl S-benzyl thiocarbonate, 4-ethoxy-1-naphthyl carbonate, methyl dithiocarbonate, 2-iodobenzoate, 4-azidobutyrate, 4-nitro-4-methylpentanoate, o-(dibromomethyl)benzoate, 2-formylbenzenesulfonate, 2-(methylthiomethoxy)ethyl, 4-(methylthiomethoxy)butyrate, 2-(methylthiomethoxymethyl)benzoate, 2,6-dichloro-4-m ethylphenoxyacetate, 2,6-dichloro-4-(1,1, 3,3-tetramethylbutyl)phenoxyacetate, 2,4-bis(1,1-dimethylpropyl)phenoxyacetate, chlorodiphenylacetate, isobutyrate, monosuccinoate, (E)-2-methyl-2-butenoate, o-(methoxycarbonyl)benzoate, α-naphthoate, nitrate, alkyl N,N,N',N'-tetramethylphosphorodiamidate, alkyl N-phenylcarbamate, borate, dimethylphosphinothioyl, alkyl 2,4-dinitrophenylsulfenate, sulfate, methanesulfonate (mesylate), benzylsulfonate, and tosylate (Ts). For protecting 1,2- or 1,3-diols, the protecting groups include methylene acetal, ethylidene acetal, 1-t-butylethylidene ketal, 1-phenylethylidene ketal, (4-methoxyphenyl)ethylidene acetal, 2,2,2-tri chloroethylidene acetal, acetonide, cyclopentylidene ketal, cyclohexylidene ketal, cycloheptylidene ketal, benzylidene acetal, p-methoxybenzylidene acetal, 2,4-dimethoxybenzylidene ketal, 3,4-dimethoxybenzylidene acetal, 2-nitrobenzylidene acetal, methoxymethylene acetal, ethoxymethylene acetal, dimethoxymethylene ortho ester, 1-methoxyethylidene ortho ester, 1-ethoxyethylidine ortho ester, 1,2-dimethoxyethylidene ortho ester, α-methoxybenzylidene ortho ester, 1-(N,N-dimethylamino)ethylidene derivative, α-(N,N'-dimethylamino)benzylidene derivative, 2-oxacyclopentylidene ortho ester, di-t-butylsilylene group (DTBS), 1,3-(1,1,3,3-tetraisopropyldisiloxanylidene) derivative (TIPDS), tetra-t-butoxydisiloxane-1,3-diylidene derivative (TBDS), cyclic carbonates, cyclic boronates, ethyl boronate, and phenyl boronate.

In some embodiments, a hydroxyl protecting group is acetyl, t-butyl, t-butoxymethyl, methoxymethyl, tetrahydropyranyl, 1-ethoxyethyl, 1-(2-chloroethoxy)ethyl, 2-trimethylsilylethyl, p-chlorophenyl, 2,4-dinitrophenyl, benzyl, benzoyl, p-phenylbenzoyl, 2,6-dichlorobenzyl, diphenylmethyl, p-nitrobenzyl, triphenylmethyl (trityl), 4,4'-dimethoxytrityl, trimethylsilyl, triethylsilyl, t-butyldimethylsilyl, t-butyldiphenylsilyl, triphenylsilyl, triisopropylsilyl, benzoylformate, chloroacetyl, trichloroacetyl, trifluoroacetyl, pivaloyl, 9-fluorenylmethyl carbonate, mesylate, tosylate, triflate, trityl, monomethoxytrityl (MMTr), 4,4'-dimethoxytrityl, (DMTr) and 4,4',4"-trimethoxytrityl (TMTr), 2-cyanoethyl (CE or Cne), 2-(trimethylsilyl)ethyl (TSE), 2-(2-nitrophenyl)ethyl, 2-(4-cyanophenyl)ethyl 2-(4-nitrophenyl)ethyl (NPE), 2-(4-nitrophenylsulfonyl)ethyl, 3,5-dichlorophenyl, 2,4-dimethylphenyl, 2-nitrophenyl, 4-nitrophenyl, 2,4,6-trimethylphenyl, 2-(2-nitrophenyl)ethyl, butylthiocarbonyl, 4,4',4"-tris(benzoyloxy)trityl, diphenylcarbamoyl, levulinyl, 2-(dibromomethyl)benzoyl (Dbmb), 2-(isopropylthiomethoxymethyl)benzoyl (Ptmt), 9-phenylxanthen-9-yl (pixyl) or 9-(p-methoxyphenyl)xanthine-9-yl (MOX). In some embodiments, each of the hydroxyl protecting groups is, independently selected from acetyl, benzyl, t-butyldimethylsilyl, t-butyldiphenylsilyl and 4,4'-dimethoxytrityl. In some embodiments, the hydroxyl protecting group is selected from the group consisting of trityl, monomethoxytrityl and 4,4'-dimethoxytrityl group.

In some embodiments, a phosphorous protecting group is a group attached to the internucleotide phosphorous linkage throughout oligonucleotide synthesis. In some embodiments, the phosphorous protecting group is attached to the sulfur atom of the internucleotide phosphorothioate linkage. In some embodiments, the phosphorous protecting group is attached to the oxygen atom of the internucleotide phosphorothioate linkage. In some embodiments, the phosphorous protecting group is attached to the oxygen atom of the internucleotide phosphate linkage. In some embodiments the phosphorous protecting group is 2-cyanoethyl (CE or Cne), 2-trimethylsilylethyl, 2-nitroethyl, 2-sulfonylethyl, methyl, benzyl, o-nitrobenzyl, 2-(p-nitrophenyl)ethyl (NPE or Npe), 2-phenylethyl, 3-(N-tert-butylcarboxamido)-1-propyl, 4-oxopentyl, 4-methylthio-1-butyl, 2-cyano-1,1-dimethylethyl, 4-N-methylaminobutyl, 3-(2-pyridyl)-1-propyl, 2-[N-methyl-N-(2-pyridyl)]aminoethyl, 2-(N-formyl,N-methyl) aminoethyl, 4-[N-methyl-N-(2,2,2-trifluoroacetyl)amino]butyl.

Protein: As used herein, the term "protein" refers to a polypeptide (i.e., a string of at least two amino acids linked to one another by peptide bonds). In some embodiments, proteins include only naturally-occurring amino acids. In some embodiments, proteins include one or more non-naturally-occurring amino acids (e.g., moieties that form one or more peptide bonds with adjacent amino acids). In some embodiments, one or more residues in a protein chain contain a non-amino-acid moiety (e.g., a glycan, etc). In some embodiments, a protein includes more than one polypeptide chain, for example linked by one or more disulfide bonds or associated by other means. In some embodiments, proteins contain L-amino acids, D-amino acids, or both; in some embodiments, proteins contain one or more amino acid modifications or analogs known in the art. Useful modifications include, e.g., terminal acetylation, amidation, methylation, etc. The term "peptide" is generally used to refer to a polypeptide having a length of less than about 100 amino acids, less than about 50 amino acids, less than 20 amino acids, or less than 10 amino acids. In some embodiments, proteins are antibodies, antibody fragments, biologically active portions thereof, and/or characteristic portions thereof.

Sample: As used herein, the term "sample" refers to a biological sample obtained or derived from a source of interest, as described herein. In some embodiments, a source of interest comprises an organism, such as an animal or human. In some embodiments, a biological sample comprises biological tissue or fluid. In some embodiments, a biological sample is or comprises bone marrow; blood; blood cells; ascites; tissue or fine needle biopsy samples; cell-containing body fluids; free floating nucleic acids; sputum; saliva; urine; cerebrospinal fluid, peritoneal fluid; pleural fluid; feces; lymph; gynecological fluids; skin swabs; vaginal swabs; oral swabs; nasal swabs; washings or lavages such as a ductal lavages or broncheoalveolar lavages; aspirates; scrapings; bone marrow specimens; tissue biopsy specimens; surgical specimens; feces, other body fluids, secretions, and/or excretions; and/or cells therefrom, etc. In some embodiments, a biological sample is or comprises cells obtained from an individual. In some embodiments, a sample is a "primary sample" obtained directly from a source of interest by any appropriate means. For example, in some embodiments, a primary biological sample is obtained by methods selected from the group consisting of biopsy (e.g., fine needle aspiration or tissue biopsy), surgery, collection of body fluid (e.g., blood, lymph, feces etc.), etc. In some embodiments, as will be clear from context, the term "sample" refers to a preparation that is obtained by processing (e.g., by removing one or more components of and/or by adding one or more agents to) a primary sample. For example, filtering using a semi-permeable membrane. Such a "processed sample" may comprise, for example nucleic acids or proteins extracted from a sample or obtained by subjecting a primary sample to techniques such as amplification or reverse transcription of mRNA, isolation and/or purification of certain components, etc.

Stereochemically isomeric forms: The phrase "stereochemically isomeric forms," as used herein, refers to different compounds made up of the same atoms bonded by the same sequence of bonds but having different three-dimensional structures which are not interchangeable. In some embodiments of the invention, provided chemical compositions may be or include pure preparations of individual stereochemically isomeric forms of a compound; in some embodiments, provided chemical compositions may be or include mixtures of two or more stereochemically isomeric forms of the compound. In certain embodiments, such mixtures contain equal amounts of different stereochemically isomeric forms; in certain embodiments, such mixtures contain different amounts of at least two different stereochemically isomeric forms. In some embodiments, a chemical composition may contain all diastereomers and/or enantiomers of the compound. In some embodiments, a chemical composition may contain less than all diastereomers and/or enantiomers of a compound. In some embodiments, if a particular enantiomer of a compound of the present invention is desired, it may be prepared, for example, by asymmetric synthesis, or by derivation with a chiral auxiliary, where the resulting diastereomeric mixture is separated and the auxiliary group cleaved to provide the pure desired enantiomers. Alternatively, where the molecule contains a basic functional group, such as amino, diastereomeric salts are formed with an appropriate optically-active acid, and resolved, for example, by fractional crystallization.

Subject: As used herein, the term "subject" or "test subject" refers to any organism to which a provided compound or composition is administered in accordance with the present invention e.g., for experimental, diagnostic, prophylactic, and/or therapeutic purposes. Typical subjects include animals (e.g., mammals such as mice, rats, rabbits, non-human primates, and humans; insects; worms; etc.) and plants. In some embodiments, a subject may be suffering from, and/or susceptible to a disease, disorder, and/or condition.

Substantially. As used herein, the term "substantially" refers to the qualitative condition of exhibiting total or near-total extent or degree of a characteristic or property of interest. One of ordinary skill in the biological arts will understand that biological and chemical phenomena rarely, if ever, go to completion and/or proceed to completeness or achieve or avoid an absolute result. The term "substantially" is therefore used herein to capture the potential lack of completeness inherent in many biological and/or chemical phenomena.

Suffering from: An individual who is "suffering from" a disease, disorder, and/or condition has been diagnosed with and/or displays one or more symptoms of a disease, disorder, and/or condition.

Susceptible to: An individual who is "susceptible to" a disease, disorder, and/or condition is one who has a higher risk of developing the disease, disorder, and/or condition than does a member of the general public. In some embodiments, an individual who is susceptible to a disease, disorder and/or condition may not have been diagnosed with the disease, disorder, and/or condition. In some embodiments, an individual who is susceptible to a disease, disorder, and/or condition may exhibit symptoms of the disease, disorder, and/or condition. In some embodiments, an individual who is susceptible to a disease, disorder, and/or condition may not exhibit symptoms of the disease, disorder, and/or condition. In some embodiments, an individual who is susceptible to a disease, disorder, and/or condition will develop the disease, disorder, and/or condition. In some embodiments, an individual who is susceptible to a disease, disorder, and/or condition will not develop the disease, disorder, and/or condition.

Systemic: The phrases "systemic administration," "administered systemically," "peripheral administration," and "administered peripherally" as used herein have their art-understood meaning referring to administration of a compound or composition such that it enters the recipient's system.

Tautomeric forms: The phrase "tautomeric forms," as used herein, is used to describe different isomeric forms of organic compounds that are capable of facile interconversion. Tautomers may be characterized by the formal migration of a hydrogen atom or proton, accompanied by a switch of a single bond and adjacent double bond. In some embodiments, tautomers may result from prototropic tautomerism (i.e., the relocation of a proton). In some embodiments, tautomers may result from valence tautomerism (i.e., the rapid reorganization of bonding electrons). All such tautomeric forms are intended to be included within the scope of the present invention. In some embodiments, tautomeric forms of a compound exist in mobile equilibrium with each other, so that attempts to prepare the separate substances results in the formation of a mixture. In some embodiments, tautomeric forms of a compound are separable and isolatable compounds. In some embodiments of the invention, chemical compositions may be provided that are or include pure preparations of a single tautomeric form of a compound. In some embodiments of the invention, chemical compositions may be provided as mixtures of two or more tautomeric forms of a compound. In certain embodiments, such mixtures contain equal amounts of different tautomeric forms; in certain embodiments, such mixtures contain different amounts of at least two different tautomeric forms of a compound. In some embodiments of the invention, chemical compositions may contain all tautomeric forms of a compound. In some embodiments of the invention, chemical compositions may contain less than all tautomeric forms of a compound. In some embodiments of the invention, chemical compositions may contain one or more tautomeric forms of a compound in amounts that vary over time as a result of interconversion. In some embodiments of the invention, the tautomerism is keto-enol tautomerism. One of skill in the chemical arts would recognize that a keto-enol tautomer can be "trapped" (i.e., chemically modified such that it remains in the "enol" form) using any suitable reagent known in the chemical arts in to provide an enol derivative that may subsequently be isolated using one or more suitable techniques known in the art. Unless otherwise indicated, the present invention encompasses all tautomeric forms of relevant compounds, whether in pure form or in admixture with one another.

Therapeutic agent: As used herein, the phrase "therapeutic agent" refers to any agent that, when administered to a subject, has a therapeutic effect and/or elicits a desired biological and/or pharmacological effect. In some embodiments, a therapeutic agent is any substance that can be used to alleviate, ameliorate, relieve, inhibit, prevent, delay onset of, reduce severity of, and/or reduce incidence of one or more symptoms or features of a disease, disorder, and/or condition.

Therapeutically effective amount: As used herein, the term "therapeutically effective amount" means an amount of a substance (e.g., a therapeutic agent, composition, and/or formulation) that elicits a desired biological response when administered as part of a therapeutic regimen. In some embodiments, a therapeutically effective amount of a substance is an amount that is sufficient, when administered to a subject suffering from or susceptible to a disease, disorder, and/or condition, to treat, diagnose, prevent, and/or delay the onset of the disease, disorder, and/or condition. As will be appreciated by those of ordinary skill in this art, the effective amount of a substance may vary depending on such factors as the desired biological endpoint, the substance to be delivered, the target cell or tissue, etc. For example, the effective amount of compound in a formulation to treat a disease, disorder, and/or condition is the amount that alleviates, ameliorates, relieves, inhibits, prevents, delays onset of, reduces severity of and/or reduces incidence of one or more symptoms or features of the disease, disorder, and/or condition. In some embodiments, a therapeutically effective amount is administered in a single dose; in some embodiments, multiple unit doses are required to deliver a therapeutically effective amount.

Treat: As used herein, the term "treat," "treatment," or "treating" refers to any method used to partially or completely alleviate, ameliorate, relieve, inhibit, prevent, delay onset of, reduce severity of, and/or reduce incidence of one or more symptoms or features of a disease, disorder, and/or condition. Treatment may be administered to a subject who does not exhibit signs of a disease, disorder, and/or condition. In some embodiments, treatment may be administered to a subject who exhibits only early signs of the disease, disorder, and/or condition, for example for the purpose of decreasing the risk of developing pathology associated with the disease, disorder, and/or condition.

Unsaturated: The term "unsaturated," as used herein, means that a moiety has one or more units of unsaturation.

Unit dose: The expression "unit dose" as used herein refers to an amount administered as a single dose and/or in a physically discrete unit of a pharmaceutical composition. In many embodiments, a unit dose contains a predetermined quantity of an active agent. In some embodiments, a unit dose contains an entire single dose of the agent. In some embodiments, more than one unit dose is administered to achieve a total single dose. In some embodiments, administration of multiple unit doses is required, or expected to be required, in order to achieve an intended effect. A unit dose may be, for example, a volume of liquid (e.g., an acceptable carrier) containing a predetermined quantity of one or more therapeutic agents, a predetermined amount of one or more therapeutic agents in solid form, a sustained release formulation or drug delivery device containing a predetermined amount of one or more therapeutic agents, etc. It will be appreciated that a unit dose may be present in a formulation that includes any of a variety of components in addition to the therapeutic agent(s). For example, acceptable carriers (e.g., pharmaceutically acceptable carriers), diluents, stabilizers, buffers, preservatives, etc., may be included as described infra. It will be appreciated by those skilled in the art, in many embodiments, a total appropriate daily dosage of a particular therapeutic agent may comprise a portion, or a plurality, of unit doses, and may be decided, for example, by the attending physician within the scope of sound medical judgment. In some embodiments, the specific effective dose level for any particular subject or organism may depend upon a variety of factors including the disorder being treated and the severity of the disorder; activity of specific active compound employed; specific composition employed; age, body weight, general health, sex and diet of the subject; time of administration, and rate of excretion of the specific active compound employed; duration of the treatment; drugs and/or additional therapies used in combination or coincidental with specific compound(s) employed, and like factors well known in the medical arts.

Wild-type: As used herein, the term "wild-type" has its art-understood meaning that refers to an entity having a structure and/or activity as found in nature in a "normal" (as contrasted with mutant, diseased, altered, etc) state or context. Those of ordinary skill in the art will appreciate that wild type genes and polypeptides often exist in multiple different forms (e.g., alleles).

Nucleic acid: The term "nucleic acid" includes any nucleotides, analogs thereof, and polymers thereof. The term "polynucleotide" as used herein refer to a polymeric form of nucleotides of any length, either ribonucleotides (RNA) or deoxyribonucleotides (DNA). These terms refer to the primary structure of the molecules and, thus, include double- and single-stranded DNA, and double- and single-stranded RNA. These terms include, as equivalents, analogs of either RNA or DNA made from nucleotide analogs and modified polynucleotides such as, though not limited to, methylated, protected and/or capped nucleotides or polynucleotides. The terms encompass poly- or oligo-ribonucleotides (RNA) and poly- or oligo-deoxyribonucleotides (DNA); RNA or DNA derived from N-glycosides or C-glycosides of nucleobases and/or modified nucleobases; nucleic acids derived from sugars and/or modified sugars; and nucleic acids derived from phosphate bridges and/or modified phosphorus-atom bridges (also referred to herein as "internucleotide linkages"). The term encompasses nucleic acids containing any combinations of nucleobases, modified nucleobases, sugars, modified sugars, phosphate bridges or modified phosphorus atom bridges. Examples include, and are not limited to, nucleic acids containing ribose moieties, the nucleic acids containing deoxy-ribose moieties, nucleic acids containing both ribose and deoxyribose moieties, nucleic acids containing ribose and modified ribose moieties. The prefix poly- refers to a nucleic acid containing 2 to about 10,000 nucleotide monomer units and wherein the prefix oligo- refers to a nucleic acid containing 2 to about 200 nucleotide monomer units.

Nucleotide: The term "nucleotide" as used herein refers to a monomeric unit of a polynucleotide that consists of a heterocyclic base, a sugar, and one or more phosphate groups or phosphorus-containing internucleotidic linkages. The naturally occurring bases, (guanine, (G), adenine, (A), cytosine, (C), thymine, (T), and uracil (U)) are derivatives of purine or pyrimidine, though it should be understood that naturally and non-naturally occurring base analogs are also included. The naturally occurring sugar is the pentose (five-carbon sugar) deoxyribose (which forms DNA) or ribose (which forms RNA), though it should be understood that naturally and non-naturally occurring sugar analogs are also included. Nucleotides are linked via internucleotidic linkages to form nucleic acids, or polynucleotides. Many internucleotidic linkages are known in the art (such as, though not limited to, phosphate, phosphorothioates, boranophosphates and the like). Artificial nucleic acids include PNAs (peptide nucleic acids), phosphotriesters, phosphorothionates, H-phosphonates, phosphoramidates, boranophosphates, methylphosphonates, phosphonoacetates, thiophosphonoacetates and other variants of the phosphate backbone of native nucleic acids, such as those described herein.

Nucleoside: The term "nucleoside" refers to a moiety wherein a nucleobase or a modified nucleobase is covalently bound to a sugar or modified sugar.

Sugar: The term "sugar" refers to a monosaccharide in closed and/or open form. Sugars include, but are not limited to, ribose, deoxyribose, pentofuranose, pentopyranose, and hexopyranose moieties. As used herein, the term also encompasses structural analogs used in lieu of conventional sugar molecules, such as glycol, polymer of which forms the backbone of the nucleic acid analog, glycol nucleic acid ("GNA").

Modified sugar: The term "modified sugar" refers to a moiety that can replace a sugar. The modified sugar mimics the spatial arrangement, electronic properties, or some other physicochemical property of a sugar.

Nucleobase: The term "nucleobase" refers to the parts of nucleic acids that are involved in the hydrogen-bonding that binds one nucleic acid strand to another complementary strand in a sequence specific manner. The most common naturally-occurring nucleobases are adenine (A), guanine (G), uracil (U), cytosine (C), and thymine (T). In some embodiments, the naturally-occurring nucleobases are modified adenine, guanine, uracil, cytosine, or thymine. In some embodiments, the naturally-occurring nucleobases are methylated adenine, guanine, uracil, cytosine, or thymine. In some embodiments, a nucleobase is a "modified nucleobase," e.g., a nucleobase other than adenine (A), guanine (G), uracil (U), cytosine (C), and thymine (T). In some embodiments, the modified nucleobases are methylated adenine, guanine, uracil, cytosine, or thymine. In some embodiments, the modified nucleobase mimics the spatial arrangement, electronic properties, or some other physicochemical property of the nucleobase and retains the property of hydrogen-bonding that binds one nucleic acid strand to another in a sequence specific manner. In some embodiments, a modified nucleobase can pair with all of the five naturally occurring bases (uracil, thymine, adenine, cytosine, or guanine) without substantially affecting the melting behavior, recognition by intracellular enzymes or activity of the oligonucleotide duplex.

Chiral ligand: The term "chiral ligand" or "chiral auxiliary" refers to a moiety that is chiral and can be incorporated into a reaction so that the reaction can be carried out with certain stereoselectivity.

Condensing reagent: In a condensation reaction, the term "condensing reagent" refers to a reagent that activates a less reactive site and renders it more susceptible to attack by another reagent. In some embodiments, such another reagent is a nucleophile.

Blocking group: The term "blocking group" refers to a group that masks the reactivity of a functional group. The functional group can be subsequently unmasked by removal of the blocking group. In some embodiments, a blocking group is a protecting group.

Moiety: The term "moiety" refers to a specific segment or functional group of a molecule. Chemical moieties are often recognized chemical entities embedded in or appended to a molecule.

Solid support: The term "solid support" refers to any support which enables synthesis of nucleic acids. In some embodiments, the term refers to a glass or a polymer, that is insoluble in the media employed in the reaction steps performed to synthesize nucleic acids, and is derivatized to comprise reactive groups. In some embodiments, the solid support is Highly Cross-linked Polystyrene (HCP) or Controlled Pore Glass (CPG). In some embodiments, the solid support is Controlled Pore Glass (CPG). In some embodiments, the solid support is hybrid support of Controlled Pore Glass (CPG) and Highly Cross-linked Polystyrene (HCP).

Linking moiety: The term "linking moiety" refers to any moiety optionally positioned between the terminal nucleoside and the solid support or between the terminal nucleoside and another nucleoside, nucleotide, or nucleic acid.

DNA molecule: A "DNA molecule" refers to the polymeric form of deoxyribonucleotides (adenine, guanine, thymine, or cytosine) in its either single stranded form or a double-stranded helix. This term refers only to the primary and secondary structure of the molecule, and does not limit it to any particular tertiary forms. Thus, this term includes double-stranded DNA found, inter alia, in linear DNA molecules (e.g., restriction fragments), viruses, plasmids, and chromosomes. In discussing the structure of particular double-stranded DNA molecules, sequences can be described herein according to the normal convention of giving only the sequence in the 5' to 3' direction along the non-transcribed strand of DNA (i.e., the strand having a sequence homologous to the mRNA).

Coding sequence: A DNA "coding sequence" or "coding region" is a double-stranded DNA sequence which is transcribed and translated into a polypeptide in vivo when placed under the control of appropriate expression control sequences. The boundaries of the coding sequence (the "open reading frame" or "ORF") are determined by a start codon at the 5' (amino) terminus and a translation stop codon at the 3' (carboxyl) terminus. A coding sequence can include, but is not limited to, prokaryotic sequences, cDNA from eukaryotic mRNA, genomic DNA sequences from eukaryotic (e.g., mammalian) DNA, and synthetic DNA sequences. A polyadenylation signal and transcription termination sequence is, usually, be located 3' to the coding sequence. The term "non-coding sequence" or "non-coding region" refers to regions of a polynucleotide sequence that are not translated into amino acids (e.g. 5' and 3' un-translated regions).

Reading frame: The term "reading frame" refers to one of the six possible reading frames, three in each direction, of the double stranded DNA molecule. The reading frame that is used determines which codons are used to encode amino acids within the coding sequence of a DNA molecule.

Antisense: As used herein, an "antisense" nucleic acid molecule comprises a nucleotide sequence which is complementary to a "sense" nucleic acid encoding a protein, e.g., complementary to the coding strand of a double-stranded cDNA molecule, complementary to an mRNA sequence or complementary to the coding strand of a gene. Accordingly, an antisense nucleic acid molecule can associate via hydrogen bonds to a sense nucleic acid molecule.

Wobble position: As used herein, a "wobble position" refers to the third position of a codon. Mutations in a DNA molecule within the wobble position of a codon, in some embodiments, result in silent or conservative mutations at the amino acid level. For example, there are four codons that encode Glycine, i.e., GGU, GGC, GGA and GGG, thus mutation of any wobble position nucleotide, to any other nucleotide selected from A, U, C and G, does not result in a change at the amino acid level of the encoded protein and, therefore, is a silent substitution.

Silent substitution: a "silent substitution" or "silent mutation" is one in which a nucleotide within a codon is modified, but does not result in a change in the amino acid residue encoded by the codon. Examples include mutations in the third position of a codon, as well in the first position of certain codons such as in the codon "CGG" which, when mutated to AGG, still encodes Arg.

Gene: The terms "gene," "recombinant gene" and "gene construct" as used herein, refer to a DNA molecule, or portion of a DNA molecule, that encodes a protein or a portion thereof. The DNA molecule can contain an open reading frame encoding the protein (as exon sequences) and can further include intron sequences. The term "intron" as used herein, refers to a DNA sequence present in a given gene which is not translated into protein and is found in some, but not all cases, between exons. It can be desirable for the gene to be operably linked to, (or it can comprise), one or more promoters, enhancers, repressors and/or other regulatory sequences to modulate the activity or expression of the gene, as is well known in the art.

Complementary DNA: As used herein, a "complementary DNA" or "cDNA" includes recombinant polynucleotides synthesized by reverse transcription of mRNA and from which intervening sequences (introns) have been removed.

Homology: "Homology" or "identity" or "similarity" refers to sequence similarity between two nucleic acid molecules. Homology and identity can each be determined by comparing a position in each sequence which can be aligned for purposes of comparison. When an equivalent position in the compared sequences is occupied by the same base, then the molecules are identical at that position; when the equivalent site occupied by the same or a similar nucleic acid residue (e.g., similar in steric and/or electronic nature), then the molecules can be referred to as homologous (similar) at that position. Expression as a percentage of homology/similarity or identity refers to a function of the number of identical or similar nucleic acids at positions shared by the compared sequences. A sequence which is "unrelated" or "non-homologous" shares less than 40% identity, less than 35% identity, less than 30% identity, or less than 25% identity with a sequence described herein. In comparing two sequences, the absence of residues (amino acids or nucleic acids) or presence of extra residues also decreases the identity and homology/similarity.

In some embodiments, the term "homology" describes a mathematically based comparison of sequence similarities which is used to identify genes with similar functions or motifs. The nucleic acid sequences described herein can be used as a "query sequence" to perform a search against public databases, for example, to identify other family members, related sequences or homologs. In some embodiments, such searches can be performed using the NBLAST and XBLAST programs (version 2.0) of Altschul, et al. (1990) J. Mol. Biol. 215:403-10. In some embodiments, BLAST nucleotide searches can be performed with the NBLAST program, score=100, wordlength=12 to obtain nucleotide sequences homologous to nucleic acid molecules of the invention. In some embodiments, to obtain gapped alignments for comparison purposes, Gapped BLAST can be utilized as described in Altschul et al., (1997) Nucleic Acids Res. 25(17):3389-3402. When utilizing BLAST and Gapped BLAST programs, the default parameters of the respective programs (e.g., XBLAST and BLAST) can be used (See www.ncbi.nlm.nih.gov).

Identity: As used herein, "identity" means the percentage of identical nucleotide residues at corresponding positions in two or more sequences when the sequences are aligned to maximize sequence matching, i.e., taking into account gaps and insertions. Identity can be readily calculated by known methods, including but not limited to those described in (Computational Molecular Biology, Lesk, A. M., ed., Oxford University Press, New York, 1988; Biocomputing: Informatics and Genome Projects, Smith, D. W., ed., Academic Press, New York, 1993; Computer Analysis of Sequence Data, Part I, Griffin, A. M., and Griffin, H. G., eds., Humana Press, New Jersey, 1994; Sequence Analysis in Molecular Biology, von Heinje, G., Academic Press, 1987; and Sequence Analysis Primer, Gribskov, M. and Devereux, J., eds., M Stockton Press, New York, 1991; and Carillo, H., and Lipman, D., SIAM J. Applied Math., 48: 1073 (1988). Methods to determine identity are designed to give the largest match between the sequences tested. Moreover, methods to determine identity are codified in publicly available computer programs. Computer program methods to determine identity between two sequences include, but are not limited to, the GCG program package (Devereux, J., et al., Nucleic Acids Research 12(1): 387 (1984)), BLASTP, BLASTN, and FASTA (Altschul, S. F. et al., J. Molec. Biol. 215: 403-410 (1990) and Altschul et al. Nuc. Acids Res. 25: 3389-3402 (1997)). The BLAST X program is publicly available from NCBI and other sources (BLAST Manual, Altschul, S., et al., NCBI NLM NIH Bethesda, Md. 20894; Altschul, S., et al., J. Mol. Biol. 215: 403-410 (1990). The well-known Smith Waterman algorithm can also be used to determine identity.

Heterologous: A "heterologous" region of a DNA sequence is an identifiable segment of DNA within a larger DNA sequence that is not found in association with the larger sequence in nature. Thus, when the heterologous region encodes a mammalian gene, the gene can usually be flanked by DNA that does not flank the mammalian genomic DNA in the genome of the source organism. Another example of a heterologous coding sequence is a sequence where the coding sequence itself is not found in nature (e.g., a cDNA where the genomic coding sequence contains introns or synthetic sequences having codons or motifs different than the unmodified gene). Allelic variations or naturally-occurring mutational events do not give rise to a heterologous region of DNA as defined herein.

Transition mutation: The term "transition mutations" refers to base changes in a DNA sequence in which a pyrimidine (cytidine (C) or thymidine (T)) is replaced by another pyrimidine, or a purine (adenosine (A) or guanosine (G) is replaced by another purine.

Transversion mutation: The term "transversion mutations" refers to base changes in a DNA sequence in which a pyrimidine (cytidine (C) or thymidine (T)) is replaced by a purine (adenosine (A) or guanosine (G), or a purine is replaced by a pyrimidine.

Oligonucleotide: the term "oligonucleotide" refers to a polymer or oligomer of nucleotide monomers, containing any combination of nucleobases, modified nucleobases, sugars, modified sugars, phosphate bridges, or modified phosphorus atom bridges (also referred to herein as "internucleotidic linkage", defined further herein).

Oligonucleotides can be single-stranded or double-stranded. As used herein, the term "oligonucleotide strand" encompasses a single-stranded oligonucleotide. A single-stranded oligonucleotide can have double-stranded regions and a double-stranded oligonucleotide can have single-stranded regions. Exemplary oligonucleotides include, but are not limited to structural genes, genes including control and termination regions, self-replicating systems such as viral or plasmid DNA, single-stranded and double-stranded siRNAs and other RNA interference reagents (RNAi agents or iRNA agents), shRNA, antisense oligonucleotides, ribozymes, microRNAs, microRNA mimics, supermirs, aptamers, antimirs, antagomirs, UI adaptors, triplex-forming oligonucleotides, G-quadruplex oligonucleotides, RNA activators, immuno-stimulatory oligonucleotides, and decoy oligonucleotides.

Double-stranded and single-stranded oligonucleotides that are effective in inducing RNA interference are also referred to as siRNA, RNAi agent, or iRNA agent, herein. In some embodiments, these RNA interference inducing oligonucleotides associate with a cytoplasmic multi-protein complex known as RNAi-induced silencing complex (RISC). In many embodiments, single-stranded and double-stranded RNAi agents are sufficiently long that they can be cleaved by an endogenous molecule, e.g., by Dicer, to produce smaller oligonucleotides that can enter the RISC machinery and participate in RISC mediated cleavage of a target sequence, e.g. a target mRNA.

Oligonucleotides of the present invention can be of various lengths. In particular embodiments, oligonucleotides can range from about 2 to about 200 nucleotides in length. In various related embodiments, oligonucleotides, single-stranded, double-stranded, and triple-stranded, can range in length from about 4 to about 10 nucleotides, from about 10 to about 50 nucleotides, from about 20 to about 50 nucleotides, from about 15 to about 30 nucleotides, from about 20 to about 30 nucleotides in length. In some embodiments, the oligonucleotide is from about 9 to about 39 nucleotides in length. In some embodiments, the oligonucleotide is at least 4 nucleotides in length. In some embodiments, the oligonucleotide is at least 5 nucleotides in length. In some embodiments, the oligonucleotide is at least 6 nucleotides in length. In some embodiments, the oligonucleotide is at least 7 nucleotides in length. In some embodiments, the oligonucleotide is at least 8 nucleotides in length. In some embodiments, the oligonucleotide is at least 9 nucleotides in length. In some embodiments, the oligonucleotide is at least 10 nucleotides in length. In some embodiments, the oligonucleotide is at least 11 nucleotides in length. In some embodiments, the oligonucleotide is at least 12 nucleotides in length. In some embodiments, the oligonucleotide is at least 15 nucleotides in length. In some embodiments, the oligonucleotide is at least 20 nucleotides in length. In some embodiments, the oligonucleotide is at least 25 nucleotides in length. In some embodiments, the oligonucleotide is at least 30 nucleotides in length. In some embodiments, the oligonucleotide is a duplex of complementary strands of at least 18 nucleotides in length. In some embodiments, the oligonucleotide is a duplex of complementary strands of at least 21 nucleotides in length.

Internucleotidic linkage: As used herein, the phrase "internucleotidic linkage" refers generally to the phosphorus-containing linkage between nucleotide units of an oligonucleotide, and is interchangeable with "inter-sugar linkage" and "phosphorus atom bridge," as used above and herein. In some embodiments, an internucleotidic linkage is a phosphodiester linkage, as found in naturally occurring DNA and RNA molecules. In some embodiments, an internucleotidic linkage is a "modified internucleotidic linkage" wherein each oxygen atom of the phosphodiester linkage is optionally and independently replaced by an organic or inorganic moiety. In some embodiments, such an organic or inorganic moiety is selected from but not limited to =S, =Se, =NR', —SR', —SeR', —N(R')$_2$, B(R')$_3$, —S—, —Se—, and —N(R')—, wherein each R' is independently as defined and described below. In some embodiments, an internucleotidic linkage is a phosphotriester linkage, phosphorothioate diester linkage

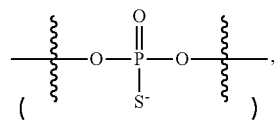

or modified phosphorothioate triester linkage. It is understood by a person of ordinary skill in the art that the internucleotidic linkage may exist as an anion or cation at a given pH due to the existence of acid or base moieties in the linkage.

Unless otherwise specified, when used with an oligonucleotide sequence, each of s, s1, s2, s3, s4, s5, s6 and s7 independently represents the following modified internucleotidic linkage as illustrated in Table 1, below.

TABLE 1

Exemplary Modified Internucleotidic Linkage.

| Symbol | Modified Internucleotidic Linkage |
|---|---|
| s | phosphorothioate ![structure] |
| s1 | ![structure with morpholine] |
| s2 | ![structure with OCH$_3$] |
| s3 | ![structure with piperazine NMe] |

TABLE 1-continued

Exemplary Modified Internucleotidic Linkage.

| Symbol | Modified Internucleotidic Linkage |
|---|---|
| s4 | (phosphorothioate linkage with –S–CH$_2$CH$_2$–O–C(O)–C(CH$_3$)$_2$–CH$_2$CH$_2$–morpholine) |
| s5 | (phosphorothioate linkage with –S–CH$_2$CH$_2$–N(CH$_3$)$_2$) |
| s6 | (phosphorothioate linkage with –S–CH$_2$CH$_2$–O–C(O)–C(CH$_3$)$_2$–NH$_2$) |
| s7 | (phosphorothioate linkage with –S–CH$_3$) |
| s8 | (phosphate linkage with –O–CH$_2$CH$_2$–O–C(O)–C(CH$_3$)$_2$–CH$_2$CH$_2$–morpholine) |
| s9 | (phosphoramidate linkage with –NH–CH$_2$CH$_2$–O–C(O)–C(CH$_3$)$_2$–CH$_2$CH$_2$–morpholine) |
| s10 | (phosphorodithioate linkage with –S–CH$_2$CH$_2$–O–C(O)–C(CH$_3$)$_2$–CH$_2$CH$_2$–morpholine) |
| s11 | (phosphoroselenoate linkage with –S–CH$_2$CH$_2$–O–C(O)–C(CH$_3$)$_2$–CH$_2$CH$_2$–morpholine) |
| s12 | (phosphorothioate linkage with –S–CH$_2$CH$_2$–O–C(O)–C(CH$_3$)$_2$–CH$_2$CH$_2$–morpholine) |
| s13 | (phosphonate linkage with CH$_2$ and –S–CH$_2$CH$_2$–O–C(O)–C(CH$_3$)$_2$–CH$_2$CH$_2$–morpholine) |
| s14 | (phosphorodithioate linkage with –S–CH$_2$CH$_2$–O–C(O)–C(CH$_3$)$_2$–CH$_2$CH$_2$–morpholine) |
| s15 | (phosphoramidothioate linkage with –NH– and –S–CH$_2$CH$_2$–O–C(O)–C(CH$_3$)$_2$–CH$_2$CH$_2$–morpholine) |

TABLE 1-continued

Exemplary Modified Internucleotidic Linkage.

| Symbol | Modified Internucleotidic Linkage |
|---|---|
| s16 | (structure) |
| s17 | (structure) |
| s18 | (structure) |

For instance, (Rp, Sp)-ATsCs1GA has 1) a phosphorothioate internucleotidic linkage

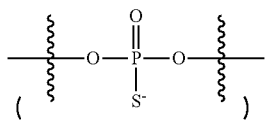

between T and C; and 2) a phosphorothioate triester internucleotidic linkage having the structure of

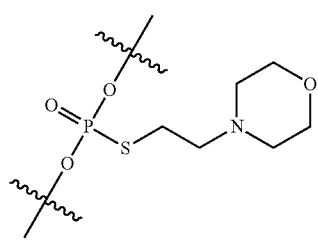

between C and G. Unless otherwise specified, the Rp/Sp designations preceding an oligonucleotide sequence describe the configurations of chiral linkage phosphorus atoms in the internucleotidic linkages sequentially from 5' to 3' of the oligonucleotide sequence. For instance, in (Rp, Sp)-ATsCs1GA, the phosphorus in the "s" linkage between T and C has Rp configuration and the phosphorus in "s1" linkage between C and G has Sp configuration. In some embodiments, "All-(Rp)" or "All-(Sp)" is used to indicate that all chiral linkage phosphorus atoms in oligonucleotide have the same Rp or Sp configuration, respectively. For instance, All-(Rp)-GsCsCsTsCsAsGsTsCsTsGsCsTsTsCsGsCsAsCsC (SEQ ID NO: 106) indicates that all the chiral linkage phosphorus atoms in the oligonucleotide have Rp configuration; All-(Sp)-GsCsCsTsCsAsGsTsCsTsGsCsTsTsCsGsCsAsCsC (SEQ ID NO: 106) indicates that all the chiral linkage phosphorus atoms in the oligonucleotide have Sp configuration.

Oligonucleotide type: As used herein, the phrase "oligonucleotide type" is used to define an oligonucleotide that has a particular base sequence, pattern of backbone linkages (i.e., pattern of internucleotidic linkage types, for example, phosphate, phosphorothioate, etc), pattern of backbone chiral centers (i.e. pattern of linkage phosphorus stereochemistry (Rp/Sp)), and pattern of backbone phosphorus modifications (e.g., pattern of "—XLR$^1$" groups in formula I). Oligonucleotides of a common designated "type" are structurally identical to one another.

One of skill in the art will appreciate that synthetic methods of the present invention provide for a degree of control during the synthesis of an oligonucleotide strand such that each nucleotide unit of the oligonucleotide strand can be designed and/or selected in advance to have a particular stereochemistry at the linkage phosphorus and/or a particular modification at the linkage phosphorus, and/or a particular base, and/or a particular sugar. In some embodiments, an oligonucleotide strand is designed and/or selected in advance to have a particular combination of stereocenters at the linkage phosphorus. In some embodiments, an oligonucleotide strand is designed and/or determined to have a particular combination of modifications at the linkage phosphorus. In some embodiments, an oligonucleotide strand is designed and/or selected to have a particular combination of bases. In some embodiments, an oligonucleotide strand is designed and/or selected to have a particular combination of one or more of the above structural characteristics. The present invention provides compositions comprising or consisting of a plurality of oligonucleotide molecules (e.g., chirally controlled oligonucleotide compositions). In some embodiments, all such molecules are of the same type (i.e., are structurally identical to one another). In many embodiments, however, provided compositions comprise a plurality of oligonucleotides of different types, typically in pre-determined relative amounts.

Chiral control: As used herein, "chiral control" refers to an ability to control the stereochemical designation of every chiral linkage phosphorus within an oligonucleotide strand. The phrase "chirally controlled oligonucleotide" refers to an oligonucleotide which exists in a single diastereomeric form with respect to the chiral linkage phosphorus.

Chirally controlled oligonucleotide composition: As used herein, the phrase "chirally controlled oligonucleotide composition" refers to an oligonucleotide composition that contains predetermined levels of individual oligonucleotide types. For instance, in some embodiments a chirally controlled oligonucleotide composition comprises one oligonucleotide type. In some embodiments, a chirally controlled oligonucleotide composition comprises more than one oligonucleotide type. In some embodiments, a chirally controlled oligonucleotide composition comprises a mixture of multiple oligonucleotide types. Exemplary chirally controlled oligonucleotide compositions are described further herein.

Chirally pure: as used herein, the phrase "chirally pure" is used to describe a chirally controlled oligonucleotide composition in which all of the oligonucleotides exist in a single diastereomeric form with respect to the linkage phosphorus.

Chirally uniform: as used herein, the phrase "chirally uniform" is used to describe an oligonucleotide molecule or type in which all nucleotide units have the same stereochemistry at the linkage phosphorus. For instance, an oligonucleotide whose nucleotide units all have Rp stereochemistry at the linkage phosphorus is chirally uniform. Likewise, an oligonucleotide whose nucleotide units all have Sp stereochemistry at the linkage phosphorus is chirally uniform.

Predetermined: By predetermined is meant deliberately selected, for example as opposed to randomly occurring or achieved. Those of ordinary skill in the art, reading the present specification, will appreciate that the present invention provides new and surprising technologies that permit selection of particular oligonucleotide types for preparation and/or inclusion in provided compositions, and further permits controlled preparation of precisely the selected particular types, optionally in selected particular relative amounts, so that provided compositions are prepared. Such provided compositions are "predetermined" as described herein. Compositions that may contain certain individual oligonucleotide types because they happen to have been generated through a process that cannot be controlled to intentionally generate the particular oligonucleotide types is not a "predetermined" composition. In some embodiments, a predetermined composition is one that can be intentionally reproduced (e.g., through repetition of a controlled process).

Linkage phosphorus: as defined herein, the phrase "linkage phosphorus" is used to indicate that the particular phosphorus atom being referred to is the phosphorus atom present in the internucleotidic linkage, which phosphorus atom corresponds to the phosphorus atom of a phosphodiester of an internucleotidic linkage as occurs in naturally occurring DNA and RNA. In some embodiments, a linkage phosphorus atom is in a modified internucleotidic linkage, wherein each oxygen atom of a phosphodiester linkage is optionally and independently replaced by an organic or inorganic moiety. In some embodiments, a linkage phosphorus atom is P* of formula I. In some embodiments, a linkage phosphorus atom is chiral. In some embodiments, a chiral linkage phosphorus atom is P* of formula I.

P-modification: as used herein, the term "P-modification" refers to any modification at the linkage phosphorus other than a stereochemical modification. In some embodiments, a P-modification comprises addition, substitution, or removal of a pendant moiety covalently attached to a linkage phosphorus. In some embodiments, the "P-modification" is —X-L-$R^1$ wherein each of X, L and $R^1$ is independently as defined and described herein and below.

Blockmer: the term "blockmer," as used herein, refers to an oligonucleotide strand whose pattern of structural features characterizing each individual nucleotide unit is characterized by the presence of at least two consecutive nucleotide units sharing a common structural feature at the internucleotidic phosphorus linkage. By common structural feature is meant common stereochemistry at the linkage phosphorus or a common modification at the linkage phosphorus. In some embodiments, the at least two consecutive nucleotide units sharing a common structure feature at the internucleotidic phosphours linkage are referred to as a "block".

In some embodiments, a blockmer is a "stereoblockmer," e.g., at least two consecutive nucleotide units have the same stereochemistry at the linkage phosphorus. Such at least two consecutive nucleotide units form a "stereoblock." For instance, (Sp, Sp)-ATsCs1GA is a stereoblockmer because at least two consecutive nucleotide units, the Ts and the Cs1, have the same stereochemistry at the linkage phosphorus (both Sp). In the same oligonucleotide (Sp, Sp)-ATsCs1GA, TsCs1 forms a block, and it is a stereoblock.

In some embodiments, a blockmer is a "P-modification blockmer," e.g., at least two consecutive nucleotide units have the same modification at the linkage phosphorus. Such at least two consecutive nucleotide units form a "P-modification block". For instance, (Rp, Sp)-ATsCsGA is a P-modification blockmer because at least two consecutive nucleotide units, the Ts and the Cs, have the same P-modification (i.e., both are a phosphorothioate diester). In the same oligonucleotide of (Rp, Sp)-ATsCsGA, TsCs forms a block, and it is a P-modification block.

In some embodiments, a blockmer is a "linkage blockmer," e.g., at least two consecutive nucleotide units have identical stereochemistry and identical modifications at the linkage phosphorus. At least two consecutive nucleotide units form a "linkage block". For instance, (Rp, Rp)-ATsCsGA is a linkage blockmer because at least two consecutive nucleotide units, the Ts and the Cs, have the same stereochemistry (both Rp) and P-modification (both phosphorothioate). In the same oligonucleotide of (Rp, Rp)-ATsCsGA, TsCs forms a block, and it is a linkage block.

In some embodiments, a blockmer comprises one or more blocks independently selected from a stereoblock, a P-modification block and a linkage block. In some embodiments, a blockmer is a stereoblockmer with respect to one block, and/or a P-modification blockmer with respect to another block, and/or a linkage blockmer with respect to yet another block. For instance, (Rp, Rp, Rp, Rp, Rp, Sp, Sp, Sp)-AAsTsCsGsAs1Ts1Cs1Gs1ATCG (SEQ ID NO: 107) is a stereoblockmer with respect to the stereoblock AsTsCsGsAs1 (all Rp at linkage phosphorus) or Ts1Cs1Gs1 (all Sp at linkage phosphorus), a P-modification blockmer with respect to the P-modification block AsTsCsGs (all s linkage) or As1Ts1Cs1Gs1 (all s1 linkage), or a linkage blockmer with respect to the linkage block AsTsCsGs (all Rp at linkage phosphorus and all s linkage) or Ts1Cs1Gs1 (all Sp at linkage phosphorus and all s1 linkage).

Altmer: the term "altmer," as used herein, refers to an oligonucleotide strand whose pattern of structural features characterizing each individual nucleotide unit is characterized in that no two consecutive nucleotide units of the oligonucleotide strand share a particular structural feature at the internucleotidic phosphorus linkage. In some embodiments, an altmer is designed such that it comprises a repeating pattern. In some embodiments, an altmer is designed such that it does not comprise a repeating pattern.

In some embodiments, an altmer is a "stereoaltmer," e.g., no two consecutive nucleotide units have the same stereochemistry at the linkage phosphorus. For instance, (Rp, Sp, Rp, Sp, Rp, Sp, Rp, Sp, Rp, Sp Rp, Sp, Rp, Sp, Rp, Sp, Rp)-GsCsCsTsCsAsGsTsCsTsGsCsTsTsCsGsCsAsCsC (SEQ ID NO: 106).

In some embodiments, an altmer is a "P-modification altmer" e.g., no two consecutive nucleotide units have the same modification at the linkage phosphorus. For instance, All-(Sp)-CAs1GsT, in which each linkage phosphorus has a different P-modification than the others.

In some embodiments, an altmer is a "linkage altmer," e.g., no two consecutive nucleotide units have identical stereochemistry or identical modifications at the linkage phosphorus. For instance, (Rp, Sp, Rp, Sp, Rp, Sp, Rp, Sp, Rp, Sp Rp, Sp, Rp, Sp, Rp, Sp, Rp, Sp, Rp)-GsCs1CsTsCsAs1GsTs1CsTs1GsCs1TsTs2CsGs3CsAs4CsC (SEQ ID NO: 106).

Unimer: the term "unimer," as used herein, refers to an oligonucleotide strand whose pattern of structural features characterizing each individual nucleotide unit is such that all nucleotide units within the strand share at least one common structural feature at the internucleotidic phosphorus linkage. By common structural feature is meant common stereochemistry at the linkage phosphorus or a common modification at the linkage phosphorus.

In some embodiments, a unimer is a "stereounimer," e.g., all nucleotide units have the same stereochemistry at the linkage phosphorus. For instance, All-(Sp)-CsAs1GsT, in which all the linkages have Sp phosphorus.

In some embodiments, a unimer is a "P-modification unimer", e.g., all nucleotide units have the same modification at the linkage phosphorus. For instance, (Rp, Sp, Rp, Sp, Rp, Sp, Rp, Sp, Rp, Sp Rp, Sp, Rp, Sp, Rp, Sp, Rp, Sp, Rp)-GsCsCsTsCsAsGsTsCsTsGsCsTsTsCsGsCsAsCsC (SEQ ID NO: 106), in which all the internucleotidic linkages are phosphorothioate diester.

In some embodiments, a unimer is a "linkage unimer," e.g., all nucleotide units have the same stereochemistry and the same modifications at the linkage phosphorus. For instance, All-(Sp)-GsCsCsTsCsAsGsTsCsTsGsCsTsTsCsGsCsAsCsC (SEQ ID NO: 106), in which all the internucleotidic linkages are phosphorothioate diester having Sp linkage phosphorus.

Gapmer: as used herein, the term "gapmer" refers to an oligonucleotide strand characterized in that at least one internucleotidic phosphorus linkage of the oligonucleotide strand is a phosphate diester linkage, for example such as those found in naturally occurring DNA or RNA. In some embodiments, more than one internucleotidic phosphorus linkage of the oligonucleotide strand is a phosphate diester linkage such as those found in naturally occurring DNA or RNA. For instance, All-(Sp)-CAs1GsT, in which the internucleotidic linkage between C and A is a phosphate diester linkage.

Skipmer: as used herein, the term "skipmer" refers to a type of gapmer in which every other internucleotidic phosphorus linkage of the oligonucleotide strand is a phosphate diester linkage, for example such as those found in naturally occurring DNA or RNA, and every other internucleotidic phosphorus linkage of the oligonucleotide strand is a modified internucleotidic linkage. For instance, All-(Sp)-AsTCs1GAs2TCs3G.

For purposes of this invention, the chemical elements are identified in accordance with the Periodic Table of the Elements, CAS version, *Handbook of Chemistry and Physics,* 67th Ed., 1986-87, inside cover.

The methods and structures described herein relating to compounds and compositions of the invention also apply to the pharmaceutically acceptable acid or base addition salts and all stereoisomeric forms of these compounds and compositions.

DETAILED DESCRIPTION OF CERTAIN EMBODIMENTS

Figure 1:
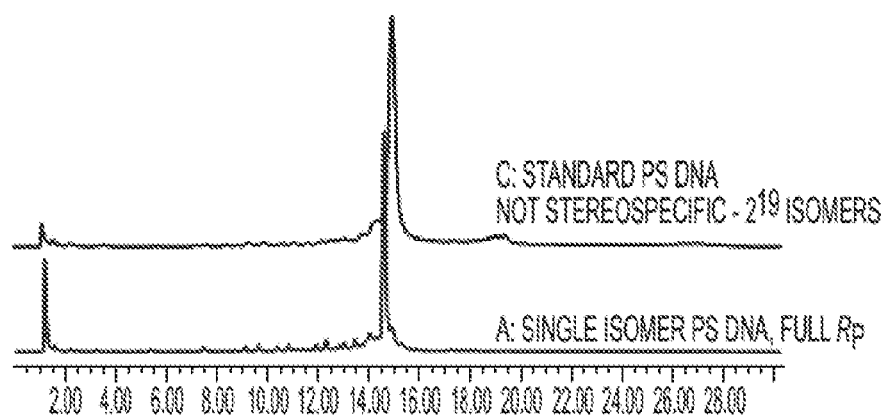
FIG. 1. Chirally controlled oligonucleotide has significantly different retention time on HPLC compared to the stereorandom oligonucleotide. A: crude chirally controlled oligonucleotide (Oligonucleotide 101); C: the corresponding stereorandom oligonucleotide (Oligonucleotide 118).

Synthetic oligonucleotides provide useful molecular tools in a wide variety of applications. For example, oligonucleotides are useful in therapeutic, diagnostic, research, and new nanomaterials applications. The use of naturally occurring nucleic acids (e.g., unmodified DNA or RNA) is limited, for example, by their susceptibility to endo- and exo-nucleases. As such, various synthetic counterparts have been developed to circumvent these shortcomings. These include synthetic oligonucleotides that contain backbone modifications, which render these molecules less susceptible to degradation. From a structural point of view, such modifications to internucleotide phosphate linkages introduce chirality. It has become clear that certain properties of oligonucleotides may be affected by the configurations of the phosphorus atoms that form the backbone of the oligonucleotides. For example, in vitro studies have shown that the properties of antisense nucleotides such as binding affinity, sequence specific binding to the complementary RNA, stability to nucleases are affected by, inter alia, chirality of the backbone (e.g., the configurations of the phosphorus atoms). Thus, the present invention encompasses the recognition that there is a need for chirally controlled oligonucleotides which comprise phosphorus atom-modified nucleic acids, as well as related compositions and methods. In some embodiments, the present invention provides chirally controlled oligonucleotides that are structurally optimized to exhibit certain desirable characteristics, such as, e.g., increased stability and improved efficacy for in vitro and/or in vivo applications.

Oligonucleotides in which one or two of the two non-bridging oxygen atoms of the internucleotidic phosphates is replaced by a different type of atom or substituent are known to be useful as therapeutic agents and probes to elucidate enzymatic reaction mechanisms. However, such oligonucleotides often exhibit undesirable properties (e.g., susceptibility to degradation by nucleases, poor cell membrane permeability) that prohibit their use in numerous applications. Thus, various types of chemical modifications have been developed in an attempt to improve their properties and/or impart new functionality.

Modified Oligonucleotide Structures

As noted above, in light of the usefulness of oligonucleotide compositions in various applications and indications, those skilled in the art have endeavoured to develop modifications of oligonucleotide structures that may have preferred or desirable characteristics or attributes as compared with naturally-occurring oligonucleotide molecules, for example as used in particular applications and indications. Exemplary such modifications are described below.

WO2010/141471 (herein "Traversa I") teaches the modification of different types of nucleic acid constructs modified to have a reduced net polyanionic charge. WO2010/039543 (herein "Travera II") teaches compositions and methods for making neutral polynucleotides (NNs) with reduced polyanionic charge. WO2008/008476 (herein, "Traversa III") describes the synthesis of SATE (Imbach-type) phosphate prodrugs. Traversa I, II, and III do not teach chirally controlled oligonucleotides, compositions thereof, and methods of making and using the same, as described by the present invention.

WO2010/072831 (herein "Girindus et al.") also teaches the modification of oligonucleotides. In particular, Girindus et al. teaches the use of sulfurization reagents to generate phosphorothioate triesters as prodrugs. Girindus et al. does not teach chirally controlled oligonucleotides, compositions thereof, and methods of making and using the same, as described by the present invention.

Similarly, WO2004/085454 (herein "Avecia I") teaches the preparation of phosphorothioate oligonucleotides through, e.g., transient silylation of poly-H-phosphonate diesters. WO2001/027126 (herein "Avecia II") teaches processes for the solid phase synthesis of phosphotriester oligonucleotides by coupling H-phosphonate monomers to a solid supported 5'-hydroxyl oligonucleotide and further sulfurization of the resulting H-phosphonate diester into a phosphorothioate triester. The disclosure of WO2001/064702 (herein "Avecia III") is similar to Avecia II and further describes solid-phase synthesis on different solid supports. Avecia I, II, and III do not teach chirally controlled oligonucleotides, compositions thereof, and methods of making and using the same, as described by the present invention.

WO1997/006183 (herein "Chiron") teaches oligonucleotides with cationic internucleotide linkages comprising asymmetric phosphorus, such as stereopure amidates. Chiron teaches stereopure oligonucleotides obtained via crystallization of a mixture of diastereomers or via resolution using, e.g., column chromatography. Chiron does not teach chirally controlled oligonucleotides, compositions thereof, and methods of making and using the same, as described by the present invention.

WO2009/146123 (herein "Spring Bank I") teaches compositions and methods for treating viral infections using substituted phosphate oligonucleotides and phosphorothioate triesters. WO2007/070598 (herein "Spring Bank II") teaches phosphotriester prodrugs as antiviral nucleic acids and teaches the synthesis of phosphorothioate prodrugs. Spring Bank I and 11 do not teach chirally controlled oligonucleotides, compositions thereof, and methods of making and using the same, as described by the present invention.

EP0779893 (herein "Hybridon") teaches lipophilic prodrugs for the increased cellular uptake of antisense oligonucleotides and observes that Rp and Sp phosphorothioates and phosphorothioate triester dimers can have different enzymatic stability properties. Hybridon does not teach chirally controlled oligonucleotides, compositions thereof, and methods of making and using the same, as described by the present invention.

WO1997/047637 (herein "Imbach I") teaches generally the Imbach "SATE" (S-acyl thioethyl) prodrug oligonucleotide compositions and methods. Imbach I describes, for example, bioreversible phosphotriester prodrugs and the preparation of certain prodrug oligonucleotides using post-synthetic alkylation or prodrug-group-containing phosphoramidites. U.S. Pat. No. 6,124,445 (herein "Imbach II") teaches modified antisense and chimeric prodrug oligonucleotides. Imbach I and II do not teach chirally controlled oligonucleotides, compositions thereof, and methods of making and using the same, as described by the present invention.

WO2006/065751 (herein "Beaucage") teaches CpG oligonucleotide phosphorothioate prodrugs that comprise thermolabile substituents (which substituents are introduced via a phosphoramidite monomer), and applications thereof. Beaucage does not teach chirally controlled oligonucleotides, compositions thereof, and methods of making and using the same, as described by the present invention.

Takeshi Wada et al. developed novel methods for the stereo-controlled synthesis of P-chiral nucleic acids using amidite chiral auxiliaries (JP4348077, WO2005/014609, WO2005/092909, and WO2010/064146, cumulatively referred to herein as "Wada I"). In particular, WO2010/064146 (referred to herein as "Wada II") discloses methods for synthesizing phosphorus atom-modified nucleic acids wherein the stereochemical configuration at phosphorus is controlled. However, the methods of Wada II are limited in that they do not provide for individual P-modification of each chiral linkage phosphorus in a controlled and designed manner. That is, the methods for P-modified linkages of Wada II provide for the generation of a condensed intermediate poly H-phosphonate oligonucleotide strand that, once built to a desired length, is mass modified at the linkage phosphorus to provide, e.g., a desired phosphorothioate diester, phosphoramidate or boranophosphate or other such phosphorus atom-modified nucleic acids (referred to as Route B in the document—Scheme 6, page 36). Furthermore, the H-phosphonate oligonucleotide strands of Wada II are of shorter lengths (e.g., dimer trimer, or tetramer). Combined with the fact that there is no capping step in route B, which generally presents low crude purity as a result of the accumulation of "n-1"-type byproducts, the Wada II route contains limitations in regards of the synthesis of longer oligonucleotides. While Wada II contemplates generally that a particular oligonucleotide could be envisaged to contain different modifications at each linkage phosphorus, Wada II does not describe or suggest methods for controlled iterative installation of such modifications, as are described herein. To the extent that Wada II depicts a synthetic cycle that does not require an H-phosphonate intermediate oligonucleotide to be completely assembled prior to modification at the linkage phosphorus (therein referred to as Route A, page 35, Scheme 5, "Synthesis of a nucleic acid comprising a chiral X-phosphonate moiety of Formula 1 via Route A"), this general disclosure does not teach certain key steps that are required to install certain P-modifications, as provided by the present invention, and especially not with any degree of efficiency and versatility such that this cycle would be useful in the synthesis of chirally controlled P-modified oligonucleotides, and especially oligonucleotides of longer lengths.

At least one such inefficiency of Wada II is noted by Wada et al. in WO2012/039448 (herein "Wada III"). Wada III teaches novel chiral auxiliaries for use in Wada II methods to produce H-phosphonate oligonucleotides that, once built, can be subsequently modified to provide, inter alia, phosphorothioates and the like. Wada et al. observe in Wada III that the four types of chiral auxiliaries disclosed in Wada II formed strong bonds with phosphorus at the linkage phosphorus and thus did not allow for efficient removal. Wada III notes that removal of the Wada II chiral auxiliaries required harsh conditions, which conditions were prone to compromising the integrity of the product oligonucleotide. Wada III observes that this is especially problematic when synthesizing long chain oligonucleotides for at least the reason that as the degradation reaction(s) proceed, additional byproducts are generated that can further react with and degrade the product oligonucleotide. Wada III therefore provides chiral auxiliaries that can be more efficiently cleaved from the oligonucleotide under mild acidic conditions by way of an $S_N1$ mechanism releasing the H-phosphonate internucleotide linkage (route B), or under relatively mild basic conditions, by a β-elimation pathway.

One of skill in the chemical and synthetic arts will immediately appreciate the complexities associated with generating chirally controlled oligonucleotides such as those provided by the present invention. For instance, in order to synthesize and isolate a chirally controlled oligonucleotide, conditions for each monomer addition must be designed such that (1) the chemistry is compatible with every portion of the growing oligonucleotide; (2) the byproducts generated during each monomer addition do not compromise the structural and stereochemical integrity of the growing oligonucleotide; and (3) the crude final product composition is a composition which allows for isolation of the desired chirally controlled oligonucleotide product.

Oligonucleotide phosphorothioates have shown therapeutic potential (Stein et al., Science (1993), 261:1004-12; Agrawal et al., Antisence Res. and Dev. (1992), 2:261-66; Bayever et al., Antisense Res. and Dev. (1993), 3:383-390). Oligonucleotide phosphorothioates prepared without regard to the stereochemistry of the phosphorothioate exist as a mixture of $2^n$ diastereomers, where n is the number of internucleotide phosphorothioates linkages. The chemical and biological properties of these diastereomeric phosphorothioates can be distinct. For example, Wada et al (Nucleic Acids Symposium Series No. 51 p. 119-120; doi:10.1093/nass/nrm060) found that stereodefined-(Rp)-(Ups)9U/(Ap)9A duplex showed a higher Tm value than that of natural-(Up)9U/(Ap)9A and stereodefined-(Sp)-(Ups)9U did not form a duplex. In another example, in a study by Tang et al., (Nucleosides Nucleotides (1995), 14:985-990) stereopure Rp-oligodeoxyribonucleoside phosphorothioates were found to possess lower stability to nucleases endogenous to human serum that the parent oligodeoxyribonucleoside phosphorothioates with undefined phosphorus chirality.

Chirally Controlled Oligonucleotides and Chirally Controlled Oligonucleotide Compositions The present invention provides chirally controlled oligonucleotides, and chirally controlled oligonucleotide compositions which are of high crude purity and of high diastereomeric purity. In some embodiments, the present invention provides chirally controlled oligonucleotides, and chirally controlled oligonucleotide compositions which are of high crude purity. In some embodiments, the present invention provides chirally controlled oligonucleotides, and chirally controlled oligonucleotide compositions which are of high diastereomeric purity.

In some embodiments, the present invention provides chirally controlled compositions comprising a plurality of oligonucleotides of at least one type, wherein each type is defined by: 1) base sequence; 2) pattern of backbone linkages; 3) pattern of backbone chiral centers; and 4) pattern of backbone P-modifications.

In some embodiments, the present invention provides chirally controlled compositions comprising a plurality of oligonucleotides of the same type, wherein each type is defined by: 1) base sequence; 2) pattern of backbone linkages; 3) pattern of backbone chiral centers; and 4) pattern of backbone P-modifications. In some embodiments, the present invention provides chirally controlled compositions comprising a plurality of oligonucleotides of two or more types, wherein each type is defined by: 1) base sequence; 2) pattern of backbone linkages; 3) pattern of backbone chiral centers; and 4) pattern of backbone P-modifications.

In some embodiments, the present invention provides oligonucleotides comprising one or more diastereomerically pure internucleotidic linkages with respect to the chiral linkage phosphorus. In some embodiments, the present invention provides oligonucleotides comprising one or more diastereomerically pure internucleotidic linkages having the structure of formula I. In some embodiments, the present invention provides oligonucleotides comprising one or more diastereomerically pure internucleotidic linkages with respect to the chiral linkage phosphorus, and one or more phosphate diester linkages. In some embodiments, the present invention provides oligonucleotides comprising one or more diastereomerically pure internucleotidic linkages having the structure of formula I, and one or more phosphate diester linkages. In some embodiments, the present invention provides oligonucleotides comprising one or more diastereomerically pure internucleotidic linkages having the structure of formula I-c, and one or more phosphate diester linkages. In some embodiments, such oligonucleotides are prepared by using stereoselective oligonucleotide synthesis, as described in this application, to form pre-designed diastereomerically pure internucleotidic linkages with respect to the chiral linkage phosphorus. For instance, in one exemplary oligonucleotide of (Rp/Sp, Rp/Sp, Rp/Sp, Rp, Rp, Sp, Sp, Sp, Sp, Sp Sp, Sp, Sp, Sp, Rp, Rp, Rp, Rp, Rp)-d [GsCsCsTsCsAsGsTsCsTsGsCsTsTsCsGs1Cs1As1CsC] (SEQ ID NO: 1061, the first three internucleotidic linkages are constructed using traditional oligonucleotide synthesis method, and the diastereomerically pure internucleotidic linkages are constructed with stereochemical control as described in this application. Exemplary internucleotidic linkages, including those having structures of formula I, are further described below. In some embodiments, such oligonucleotides comprise a sequence further described in the application, including but not limited to those described in Tables 2 and 4, and Appendices A, B and C.

In some embodiments, a provided oligonucleotide comprises a combination of stereopure and stereorandom internucleotidic linkages with respect to chirality at the linkage phosphorus. For instance, in some embodiments it is desirable to have a block of one or more stereodefined internucleotidic linkages within an oligonucleotide that is otherwise stereorandom with respect to chirality at the linkage phosphorus. In some embodiments, it is desirable to have a block of one or more internucleotidic linkages that are stereorandom within an oligonucleotide that is otherwise stereodefined with respect to chirality at the linkage phosphorus.

In some embodiments, at least one nucleotide unit of a provided oligonucleotide is installed using stereoselective oligonucleotide synthesis, as described in this application, to form a pre-designed diastereomerically pure internucleotidic linkage with respect to the chiral linkage phosphorus. In some embodiments, at least two nucleotide units of a provided oligonucleotide are installed using stereoselective oligonucleotide synthesis, as described in this application, to form at least two pre-designed diastereomerically pure internucleotidic linkages with respect to the chiral linkage phosphorus. In some embodiments, at least three nucleotide units of a provided oligonucleotide are installed using stereoselective oligonucleotide synthesis, as described in this application, to form at least three pre-designed diastereomerically pure internucleotidic linkages with respect to the chiral linkage phosphorus. In some embodiments, the at least one, two, or three pre-designed diastereomerically pure internucleotidic linkages are adjacent to one another. In some embodiments, the at least one, two, or three pre-designed diastereomerically pure internucleotidic linkages are not adjacent to one another.

In some embodiments, at least about 5%, 10%, 15%, 20%, 25%, 30%, 35%, 40%, 45%, or 50% of nucleotide units of a provided oligonucleotide are installed using stereoselective oligonucleotide synthesis, as described in this application, to form a pre-designed diastereomerically pure internucleotidic linkage with respect to the chiral linkage phosphorus. As described herein, in some embodiments the at least about 5%, 10%, 15%, 20%, 25%, 30%, 35%, 40%, 45%, or 50% of nucleotide units occur in one or more blocks to provide a blockmer. In some embodiments, the at least about 5%, 10%, 15%, 20%, 25%, 30%, 35%, 40%, 45%, or 50% of nucleotide units occur in a an alternating pattern to provide an altmer. One of skill in the relevant arts will recognize that any desirable pattern can be achieved using methods of the present invention and are contemplated herein.

In some embodiments, the present invention provides a chirally controlled oligonucleotide, wherein at least two of the individual internucleotidic linkages within the oligonucleotide have different stereochemistry and/or different P-modifications relative to one another. In certain embodiments, the present invention provides a chirally controlled oligonucleotide, wherein at least two individual internucleotidic linkages within the oligonucleotide have different P-modifications relative to one another. In certain embodiments, the present invention provides a chirally controlled oligonucleotide, wherein at least two of the individual internucleotidic linkages within the oligonucleotide have different P-modifications relative to one another, and wherein the chirally controlled oligonucleotide comprises at least one phosphate diester internucleotidic linkage. In certain embodiments, the present invention provides a chirally controlled oligonucleotide, wherein at least two of the individual internucleotidic linkages within the oligonucleotide have different P-modifications relative to one another, and wherein the chirally controlled oligonucleotide comprises at least one phosphate diester internucleotidic linkage and at least one phosphorothioate diester internucleotidic linkage. In certain embodiments, the present invention provides a chirally controlled oligonucleotide, wherein at least two of the individual internucleotidic linkages within the oligonucleotide have different P-modifications relative to one another, and wherein the chirally controlled oligonucleotide comprises at least one phosphorothioate triester internucleotidic linkage. In certain embodiments, the present invention provides a chirally controlled oligonucleotide, wherein at least two of the individual internucleotidic linkages within the oligonucleotide have different P-modifications relative to one another, and wherein the chirally controlled oligonucleotide comprises at least one phosphate diester internucleotidic linkage and at least one phosphorothioate triester internucleotidic linkage.

In certain embodiments, the present invention provides a chirally controlled oligonucleotide comprising one or more modified internucleotidic linkages independently having the structure of formula I:

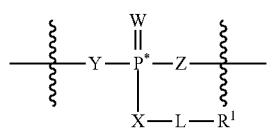

(I)

wherein each variable is as defined and described below. In some embodiments, the present invention provides a chirally controlled oligonucleotide comprising one or more modified internucleotidic linkages of formula I, and wherein individual internucleotidic linkages of formula I within the oligonucleotide have different P-modifications relative to one another. In some embodiments, the present invention provides a chirally controlled oligonucleotide comprising one or more modified internucleotidic linkages of formula I, and wherein individual internucleotidic linkages of formula I within the oligonucleotide have different —X-L-$R^1$ relative to one another. In some embodiments, the present invention provides a chirally controlled oligonucleotide comprising one or more modified internucleotidic linkages of formula I, and wherein individual internucleotidic linkages of formula I within the oligonucleotide have different X relative to one another. In some embodiments, the present invention provides a chirally controlled oligonucleotide comprising one or more modified internucleotidic linkages of formula I, and wherein individual internucleotidic linkages of formula I within the oligonucleotide have different -L-$R^1$ relative to one another.

In some embodiments, the present invention provides a chirally controlled oligonucleotide, wherein at least two of the individual internucleotidic linkages within the oligonucleotide have different stereochemistry and/or different P-modifications relative to one another. In some embodiments, the present invention provides a chirally controlled oligonucleotide, wherein at least two of the individual internucleotidic linkages within the oligonucleotide have different stereochemistry relative to one another, and wherein at least a portion of the structure of the chirally controlled oligonucleotide is characterized by a repeating pattern of alternating stereochemistry.

In some embodiments, the present invention provides a chirally controlled oligonucleotide, wherein at least two of the individual internucleotidic linkages within the oligonucleotide have different P-modifications relative to one another, in that they have different X atoms in their —XL$R^1$ moieties, and/or in that they have different L groups in their —XL$R^1$ moieties, and/or that they have different $R^1$ atoms in their —XL$R^1$ moieties.

In some embodiments, the present invention provides a chirally controlled oligonucleotide, wherein at least two of the individual internucleotidic linkages within the oligonucleotide have different stereochemistry and/or different P-modifications relative to one another and the oligonucleotide has a structure represented by the following formula:

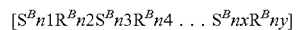

wherein:
each $R^B$ independently represents a block of nucleotide units having the R configuration at the linkage phosphorus;
each $S^B$ independently represents a block of nucleotide units having the S configuration at the linkage phosphorus;
each of n1-ny is zero or an integer, with the requirement that at least one odd n and at least one even n must be non-zero so that the oligonucleotide includes at least two individual internucleotidic linkages with different stereochemistry relative to one another; and
wherein the sum of n1-ny is between 2 and 200, and in some embodiments is between a lower limit selected from the group consisting of 2, 3, 4, 5, 6, 7, 8, 9, 10, 11, 12, 13, 14, 15, 16, 17, 18, 19, 20, 21, 22, 23, 24, 25 or more and an upper limit selected from the group consisting of 5, 10, 15, 20, 25, 30, 35, 40, 45, 50, 55, 60, 65, 70, 75, 80, 85, 90, 95, 100, 110, 120, 130, 140, 150, 160, 170, 180, 190, and 200, the upper limit being larger than the lower limit.

In some such embodiments, each n has the same value; in some embodiments, each even n has the same value as each other even n; in some embodiments, each odd n has the same value each other odd n; in some embodiments, at least two even ns have different values from one another; in some embodiments, at least two odd ns have different values from one another.

In some embodiments, at least two adjacent ns are equal to one another, so that a provided oligonucleotide includes adjacent blocks of S stereochemistry linkages and R stereochemistry linkages of equal lengths. In some embodiments, provided oligonucleotides include repeating blocks of S and R stereochemistry linkages of equal lengths. In some embodiments, provided oligonucleotides include repeating blocks of S and R stereochemistry linkages, where at least two such blocks are of different lengths from one another; in some such embodiments each S stereochemistry block is of the same length, and is of a different length from each R stereochemistry length, which may optionally be of the same length as one another.

In some embodiments, at least two skip-adjacent ns are equal to one another, so that a provided oligonucleotide includes at least two blocks of linkages of a first stereochemistry that are equal in length to one another and are separated by a block of linkages of the other stereochemistry, which separating block may be of the same length or a different length from the blocks of first stereochemistry.

In some embodiments, ns associated with linkage blocks at the ends of a provided oligonucleotide are of the same length. In some embodiments, provided oligonucleotides have terminal blocks of the same linkage stereochemistry. In some such embodiments, the terminal blocks are separated from one another by a middle block of the other linkage stereochemistry.

In some embodiments, a provided oligonucleotide of formula [$S^B n1 R^B n2 S^B n3 R^B n4 \ldots S^B nx R^B ny$] is a stereoblockmer. In some embodiments, a provided oligonucleotide of formula [$S^B n1 R^B n2 S^B n3 R^B n4 \ldots S^B nx R^B ny$] is a stereoskipmer. In some embodiments, a provided oligonucleotide of formula [$S^B n1 R^B n2 S^B n3 R^B n4 \ldots S^B nx R^B ny$] is a stereoaltmer. In some embodiments, a provided oligonucleotide of formula [$S^B n1 R^B n2 S^B n3 R^B n4 \ldots S^B nx R^B ny$] is a gapmer.

In some embodiments, a provided oligonucleotide of formula [$S^B n1 R^B n2 S^B n3 R^B n4 \ldots S^B nx R^B ny$] is of any of the above described patterns and further comprises patterns of P-modifications. For instance, in some embodiments, a provided oligonucleotide of formula [$S^B n1 R^B n2 S^B n3 R^B n4 \ldots S^B nx R^B ny$] and is a stereoskipmer and P-modification skipmer. In some embodiments, a provided oligonucleotide of formula [$S^B n1 R^B n2 S^B n3 R^B n4 \ldots S^B nx R^B ny$] and is a stereoblockmer and P-modification altmer. In some embodiments, a provided oligonucleotide of formula [$S^B n1 R^B n2 S^B n3 R^B n4 \ldots S^B nx R^B ny$] and is a stereoaltmer and P-modification blockmer.

In some embodiments, a provided oligonucleotide of formula [$S^B n1 R^B n2 S^B n3 R^B n4 \ldots S^B nx R^B ny$] is a chirally controlled oligonucleotide comprising one or more modified internucleotidic linkages independently having the structure of formula I:

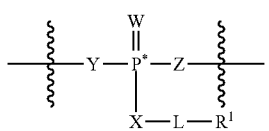

(I)

wherein:
P* is an asymmetric phosphorus atom and is either Rp or Sp;
W is O, S or Se;
each of X, Y and Z is independently —O—, —S—, —N(-L-R$^1$)—, or L;
L is a covalent bond or an optionally substituted, linear or branched $C_1$-$C_{10}$ alkylene, wherein one or more methylene units of L are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—;
R$^1$ is halogen, R, or an optionally substituted $C_1$-$C_{50}$ aliphatic wherein one or more methylene units are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR$^1$)—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—;
each R' is independently —R, —C(O)R, —CO$_2$R, or —SO$_2$R, or:
two R' on the same nitrogen are taken together with their intervening atoms to form an optionally substituted heterocyclic or heteroaryl ring, or
two R' on the same carbon are taken together with their intervening atoms to form an optionally substituted aryl, carbocyclic, heterocyclic, or heteroaryl ring;
-Cy- is an optionally substituted bivalent ring selected from phenylene, carbocyclylene, arylene, heteroarylene, or heterocyclylene;
each R is independently hydrogen, or an optionally substituted group selected from $C_1$-$C_6$ aliphatic, phenyl, carbocyclyl, aryl, heteroaryl, or heterocyclyl; and
each

independently represents a connection to a nucleoside.

In some embodiments, a chirally controlled oligonucleotide comprises one or more modified internucleotidic phosphorus linkages. In some embodiments, a chirally controlled oligonucleotide comprises, e.g., a phosphorothioate or a phosphorothioate triester linkage. In some embodiments, a chirally controlled oligonucleotide comprises a phosphorothioate triester linkage. In some embodiments, a chirally controlled oligonucleotide comprises at least two phosphorothioate triester linkages. In some embodiments, a chirally controlled oligonucleotide comprises at least three phosphorothioate triester linkages. In some embodiments, a chirally controlled oligonucleotide comprises at least four phosphorothioate triester linkages. In some embodiments, a chirally controlled oligonucleotide comprises at least five phosphorothioate triester linkages. Exemplary such modified internucleotidic phosphorus linkages are described further herein.

In some embodiments, a chirally controlled oligonucleotide comprises different internucleotidic phosphorus linkages. In some embodiments, a chirally controlled oligonucleotide comprises at least one phosphate diester internucleotidic linkage and at least one modified internucleotidic linkage. In some embodiments, a chirally controlled oligonucleotide comprises at least one phosphate diester internucleotidic linkage and at least one phosphorothioate triester linkage. In some embodiments, a chirally controlled oligonucleotide comprises at least one phosphate diester internucleotidic linkage and at least two phosphorothioate triester linkages. In some embodiments, a chirally controlled oligonucleotide comprises at least one phosphate diester internucleotidic linkage and at least three phosphorothioate triester linkages. In some embodiments, a chirally controlled oligonucleotide comprises at least one phosphate diester internucleotidic linkage and at least four phosphorothioate triester linkages. In some embodiments, a chirally controlled oligonucleotide comprises at least one phosphate diester internucleotidic linkage and at least five phosphorothioate triester linkages. Exemplary such modified internucleotidic phosphorus linkages are described further herein.

In some embodiments, a phosphorothioate triester linkage comprises a chiral auxiliary, which, for example, is used to control the stereoselectivity of a reaction. In some embodiments, a phosphorothioate triester linkage does not comprise a chiral auxiliary. In some embodiments, a phosphorothioate triester linkage is intentionally maintained until and/or during the administration to a subject.

In some embodiments, a chirally controlled oligonucleotide is linked to a solid support. In some embodiments, a chirally controlled oligonucleotide is cleaved from a solid support.

In some embodiments, a chirally controlled oligonucleotide comprises at least one phosphate diester internucleotidic linkage and at least two consecutive modified internucleotidic linkages. In some embodiments, a chirally controlled oligonucleotide comprises at least one phosphate diester internucleotidic linkage and at least two consecutive phosphorothioate triester internucleotidic linkages.

In some embodiments, a chirally controlled oligonucleotide is a blockmer. In some embodiments, a chirally controlled oligonucleotide is a stereoblockmer. In some embodiments, a chirally controlled oligonucleotide is a P-modification blockmer. In some embodiments, a chirally controlled oligonucleotide is a linkage blockmer.

In some embodiments, a chirally controlled oligonucleotide is an altmer. In some embodiments, a chirally controlled oligonucleotide is a stereoaltmer. In some embodiments, a chirally controlled oligonucleotide is a P-modification altmer. In some embodiments, a chirally controlled oligonucleotide is a linkage altmer.

In some embodiments, a chirally controlled oligonucleotide is a unimer. In some embodiments, a chirally controlled oligonucleotide is a stereounimer. In some embodiments, a chirally controlled oligonucleotide is a P-modification unimer. In some embodiments, a chirally controlled oligonucleotide is a linkage unimer.

In some embodiments, a chirally controlled oligonucleotide is a gapmer.

In some embodiments, a chirally controlled oligonucleotide is a skipmer.

In some embodiments, the present invention provides a chirally controlled oligonucleotide comprising one or more modified internucleotidic linkages independently having the structure of formula I:

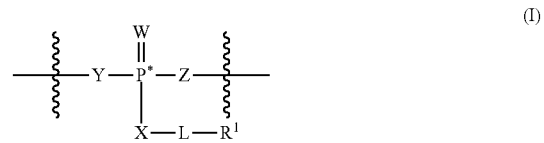

wherein:
P* is an asymmetric phosphorus atom and is either Rp or Sp;
W is O, S or Se;
each of X, Y and Z is independently —O—, —S—, —N(-L-R$^1$)—, or L; L is a covalent bond or an optionally substituted, linear or branched $C_1$-$C_{10}$ alkylene, wherein one or more methylene units of L are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—;

R$^1$ is halogen, R, or an optionally substituted $C_1$-$C_{50}$ aliphatic wherein one or more methylene units are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—;

each R' is independently —R, —C(O)R, —CO$_2$R, or —SO$_2$R, or:
two R' on the same nitrogen are taken together with their intervening atoms to form an optionally substituted heterocyclic or heteroaryl ring, or
two R' on the same carbon are taken together with their intervening atoms to form an optionally substituted aryl, carbocyclic, heterocyclic, or heteroaryl ring;

-Cy- is an optionally substituted bivalent ring selected from phenylene, carbocyclylene, arylene, heteroarylene, or heterocyclylene;

each R is independently hydrogen, or an optionally substituted group selected from $C_1$-$C_6$ aliphatic, phenyl, carbocyclyl, aryl, heteroaryl, or heterocyclyl; and
each

independently represents a connection to a nucleoside.

As defined generally above and herein, P* is an asymmetric phosphorus atom and is either Rp or Sp. In some embodiments, P* is Rp. In other embodiments, P* is Sp. In some embodiments, an oligonucleotide comprises one or more internucleotidic linkages of formula I wherein each P* is independently Rp or Sp. In some embodiments, an oligonucleotide comprises one or more internucleotidic linkages of formula I wherein each P* is Rp. In some embodiments, an oligonucleotide comprises one or more internucleotidic linkages of formula I wherein each P* is Sp. In some embodiments, an oligonucleotide comprises at least one internucleotidic linkage of formula I wherein P* is Rp.

In some embodiments, an oligonucleotide comprises at least one internucleotidic linkage of formula I wherein P* is Sp. In some embodiments, an oligonucleotide comprises at least one internucleotidic linkage of formula I wherein P* is Rp, and at least one internucleotidic linkage of formula I wherein P* is Sp.

As defined generally above and herein, W is O, S, or Se. In some embodiments, W is O. In some embodiments, W is S. In some embodiments, W is Se. In some embodiments, an oligonucleotide comprises at least one internucleotidic linkage of formula I wherein W is O. In some embodiments, an oligonucleotide comprises at least one internucleotidic linkage of formula I wherein W is S. In some embodiments, an oligonucleotide comprises at least one internucleotidic linkage of formula I wherein W is Se.

As defined generally above and herein, each R is independently hydrogen, or an optionally substituted group selected from $C_1$-$C_6$ aliphatic, phenyl, carbocyclyl, aryl, heteroaryl, or heterocyclyl.

In some embodiments, R is hydrogen. In some embodiments, R is an optionally substituted group selected from $C_1$-$C_6$ aliphatic, phenyl, carbocyclyl, aryl, heteroaryl, or heterocyclyl.

In some embodiments, R is an optionally substituted $C_1$-$C_6$ aliphatic. In some embodiments, R is an optionally substituted $C_1$-$C_6$ alkyl. In some embodiments, R is optionally substituted, linear or branched hexyl. In some embodiments, R is optionally substituted, linear or branched pentyl. In some embodiments, R is optionally substituted, linear or branched butyl. In some embodiments, R is optionally substituted, linear or branched propyl. In some embodiments, R is optionally substituted ethyl. In some embodiments, R is optionally substituted methyl.

In some embodiments, R is optionally substituted phenyl. In some embodiments, R is substituted phenyl. In some embodiments, R is phenyl.

In some embodiments, R is optionally substituted carbocyclyl. In some embodiments, R is optionally substituted $C_3$-$C_{10}$ carbocyclyl. In some embodiments, R is optionally substituted monocyclic carbocyclyl. In some embodiments, R is optionally substituted cycloheptyl. In some embodiments, R is optionally substituted cyclohexyl. In some embodiments, R is optionally substituted cyclopentyl. In some embodiments, R is optionally substituted cyclobutyl. In some embodiments, R is an optionally substituted cyclopropyl. In some embodiments, R is optionally substituted bicyclic carbocyclyl.

In some embodiments, R is an optionally substituted aryl. In some embodiments, R is an optionally substituted bicyclic aryl ring.

In some embodiments, R is an optionally substituted heteroaryl. In some embodiments, R is an optionally substituted 5-6 membered monocyclic heteroaryl ring having 1-3 heteroatoms independently selected from nitrogen, sulfur, or oxygen. In some embodiments, R is a substituted 5-6 membered monocyclic heteroaryl ring having 1-3 heteroatoms independently selected from nitrogen, oxygen, or sulfur. In some embodiments, R is an unsubstituted 5-6 membered monocyclic heteroaryl ring having 1-3 heteroatoms independently selected from nitrogen, sulfur, or oxygen.

In some embodiments, R is an optionally substituted 5 membered monocyclic heteroaryl ring having 1-3 heteroatoms independently selected from nitrogen, oxygen or sulfur. In some embodiments, R is an optionally substituted 6 membered monocyclic heteroaryl ring having 1-3 heteroatoms independently selected from nitrogen, oxygen, or sulfur.

In some embodiments, R is an optionally substituted 5-membered monocyclic heteroaryl ring having 1 heteroatom selected from nitrogen, oxygen, or sulfur. In some embodiments, R is selected from pyrrolyl, furanyl, or thienyl.

In some embodiments, R is an optionally substituted 5-membered heteroaryl ring having 2 heteroatoms independently selected from nitrogen, oxygen, or sulfur. In certain embodiments, R is an optionally substituted 5-membered heteroaryl ring having 1 nitrogen atom, and an additional heteroatom selected from sulfur or oxygen. Exemplary R groups include optionally substituted pyrazolyl, imidazolyl, thiazolyl, isothiazolyl, oxazolyl or isoxazolyl.

In some embodiments, R is a 6-membered heteroaryl ring having 1-3 nitrogen atoms. In other embodiments, R is an optionally substituted 6-membered heteroaryl ring having 1-2 nitrogen atoms. In some embodiments, R is an optionally substituted 6-membered heteroaryl ring having 2 nitrogen atoms. In certain embodiments, R is an optionally substituted 6-membered heteroaryl ring having 1 nitrogen. Exemplary R groups include optionally substituted pyridinyl, pyrimidinyl, pyrazinyl, pyridazinyl, triazinyl, or tetrazinyl.

In certain embodiments, R is an optionally substituted 8-10 membered bicyclic heteroaryl ring having 1-4 heteroatoms independently selected from nitrogen, oxygen, or sulfur. In some embodiments, R is an optionally substituted 5,6-fused heteroaryl ring having 1-4 heteroatoms independently selected from nitrogen, oxygen, or sulfur. In other embodiments, R is an optionally substituted 5,6-fused heteroaryl ring having 1-2 heteroatoms independently selected from nitrogen, oxygen, or sulfur. In certain embodiments, R is an optionally substituted 5,6-fused heteroaryl ring having 1 heteroatom independently selected from nitrogen, oxygen, or sulfur. In some embodiments, R is an optionally substituted indolyl. In some embodiments, R is an optionally substituted azabicyclo[3.2.1]octanyl. In certain embodiments, R is an optionally substituted 5,6-fused heteroaryl ring having 2 heteroatoms independently selected from nitrogen, oxygen, or sulfur. In some embodiments, R is an optionally substituted azaindolyl. In some embodiments, R is an optionally substituted benzimidazolyl. In some embodiments, R is an optionally substituted benzothiazolyl. In some embodiments, R is an optionally substituted benzoxazolyl. In some embodiments, R is an optionally substituted indazolyl. In certain embodiments, R is an optionally substituted 5,6-fused heteroaryl ring having 3 heteroatoms independently selected from nitrogen, oxygen, or sulfur.

In certain embodiments, R is an optionally substituted 6,6-fused heteroaryl ring having 1-4 heteroatoms independently selected from nitrogen, oxygen, or sulfur. In some embodiments, R is an optionally substituted 6,6-fused heteroaryl ring having 1-2 heteroatoms independently selected from nitrogen, oxygen, or sulfur. In other embodiments, R is an optionally substituted 6,6-fused heteroaryl ring having 1 heteroatom independently selected from nitrogen, oxygen, or sulfur. In some embodiments, R is an optionally substituted quinolinyl. In some embodiments, R is an optionally substituted isoquinolinyl. According to one aspect, R is an optionally substituted 6,6-fused heteroaryl ring having 2 heteroatoms independently selected from nitrogen, oxygen, or sulfur. In some embodiments, R is a quinazoline or a quinoxaline.

In some embodiments, R is an optionally substituted heterocyclyl. In some embodiments, R is an optionally substituted 3-7 membered saturated or partially unsaturated heterocyclic ring having 1-2 heteroatoms independently selected from nitrogen, oxygen, or sulfur. In some embodiments, R is a substituted 3-7 membered saturated or partially unsaturated heterocyclic ring having 1-2 heteroatoms independently selected from nitrogen, oxygen, or sulfur. In some embodiments, R is an unsubstituted 3-7 membered saturated or partially unsaturated heterocyclic ring having 1-2 heteroatoms independently selected from nitrogen, oxygen, or sulfur.

In some embodiments, R is an optionally substituted heterocyclyl. In some embodiments, R is an optionally substituted 6 membered saturated or partially unsaturated heterocyclic ring having 1-2 heteroatoms independently selected from nitrogen, oxygen, or sulfur. In some embodiments, R is an optionally substituted 6 membered partially unsaturated heterocyclic ring having 2 heteroatoms independently selected from nitrogen, oxygen, or sulfur. In some embodiments, R is an optionally substituted 6 membered partially unsaturated heterocyclic ring having 2 oxygen atom.

In certain embodiments, R is a 3-7 membered saturated or partially unsaturated heterocyclic ring having 1-2 heteroatoms independently selected from nitrogen, oxygen, or sulfur. In certain embodiments, R is oxiranyl, oxetanyl, tetrahydrofuranyl, tetrahydropyranyl, oxepaneyl, aziridineyl, azetidineyl, pyrrolidinyl, piperidinyl, azepanyl, thiiranyl, thietanyl, tetrahydrothiophenyl, tetrahydrothiopyranyl, thiepanyl, dioxolanyl, oxathiolanyl, oxazolidinyl, imidazolidinyl, thiazolidinyl, dithiolanyl, dioxanyl, morpholinyl, oxathianyl, piperazinyl, thiomorpholinyl, dithianyl, dioxepanyl, oxazepanyl, oxathiepanyl, dithiepanyl, diazepanyl, dihydrofuranonyl, tetrahydropyranonyl, oxepanonyl, pyrolidinonyl, piperidinonyl, azepanonyl, dihydrothiophenonyl, tetrahydrothiopyranonyl, thiepanonyl, oxazolidinonyl, oxazinanonyl, oxazepanonyl, dioxolanonyl, dioxanonyl, dioxepanonyl, oxathiolinonyl, oxathianonyl, oxathiepanonyl, thiazolidinonyl, thiazinanonyl, thiazepanonyl, imidazolidinonyl, tetrahydropyrimidinonyl, diazepanonyl, imidazolidinedionyl, oxazolidinedionyl, thiazolidinedionyl, dioxolanedionyl, oxathiolanedionyl, piperazinedionyl, morpholinedionyl, thiomorpholinedionyl, tetrahydropyranyl, tetrahydrofuranyl, morpholinyl, thiomorpholinyl, piperidinyl, piperazinyl, pyrrolidinyl, tetrahydrothiophenyl, or tetrahydrothiopyranyl. In some embodiments, R is an optionally substituted 5 membered saturated or partially unsaturated heterocyclic ring having 1-2 heteroatoms independently selected from nitrogen, oxygen, or sulfur.

In certain embodiments, R is an optionally substituted 5-6 membered partially unsaturated monocyclic ring having 1-2 heteroatoms independently selected from nitrogen, oxygen, or sulfur. In certain embodiments, R is an optionally substituted tetrahydropyridinyl, dihydrothiazolyl, dihydrooxazolyl, or oxazolinyl group.

In some embodiments, R is an optionally substituted 8-10 membered bicyclic saturated or partially unsaturated heterocyclic ring having 1-4 heteroatoms independently selected from nitrogen, oxygen, or sulfur. In some embodiments, R is an optionally substituted indolinyl. In some embodiments, R is an optionally substituted isoindolinyl. In some embodiments, R is an optionally substituted 1, 2, 3, 4-tetrahydroquinoline. In some embodiments, R is an optionally substituted 1, 2, 3, 4-tetrahydroisoquinoline.

As defined generally above and herein, each R' is independently —R, —C(O)R, —CO$_2$R, or —SO$_2$R, or:

two R' on the same nitrogen are taken together with their intervening atoms to form an optionally substituted heterocyclic or heteroaryl ring, or two R' on the same carbon are taken together with their intervening atoms to form an optionally substituted aryl, carbocyclic, heterocyclic, or heteroaryl ring.

In some embodiments, R' is —R, —C(O)R, —CO$_2$R, or —SO$_2$R, wherein R is as defined above and described herein.

In some embodiments, R' is —R, wherein R is as defined and described above and herein. In some embodiments, R' is hydrogen.

In some embodiments, R' is —C(O)R, wherein R is as defined above and described herein. In some embodiments, R' is —CO$_2$R, wherein R is as defined above and described herein. In some embodiments, R' is —SO$_2$R, wherein R is as defined above and described herein.

In some embodiments, two R' on the same nitrogen are taken together with their intervening atoms to form an optionally substituted heterocyclic or heteroaryl ring. In some embodiments, two R' on the same carbon are taken together with their intervening atoms to form an optionally substituted aryl, carbocyclic, heterocyclic, or heteroaryl ring.

As defined generally above and herein, -Cy- is an optionally substituted bivalent ring selected from phenylene, carbocyclylene, arylene, heteroarylene, or heterocyclylene.

In some embodiments, -Cy- is optionally substituted phenylene. In some embodiments, -Cy- is optionally substituted carbocyclylene. In some embodiments, -Cy- is optionally substituted arylene. In some embodiments, -Cy- is optionally substituted heteroarylene. In some embodiments, -Cy- is optionally substituted heterocyclylene.

As defined generally above and herein, each of X, Y and Z is independently —O—, —S—, —N(-L-R$^1$)—, or L, wherein each of L and R$^1$ is independently as defined above and described below.

In some embodiments, X is —O—. In some embodiments, X is —S—. In some embodiments, X is —O— or —S—. In some embodiments, an oligonucleotide comprises at least one internucleotidic linkage of formula I wherein X is —O—. In some embodiments, an oligonucleotide comprises at least one internucleotidic linkage of formula I wherein X is —S—. In some embodiments, an oligonucleotide comprises at least one internucleotidic linkage of formula I wherein X is —O—, and at least one internucleotidic linkage of formula I wherein X is —S—. In some embodiments, an oligonucleotide comprises at least one internucleotidic linkage of formula I wherein X is —O—, and at least one internucleotidic linkage of formula I wherein X is —S—, and at least one internucleotidic linkage of formula I wherein L is an optionally substituted, linear or branched C$_1$-C$_{10}$ alkylene, wherein one or more methylene units of L are optionally and independently replaced by an optionally substituted C$_1$-C$_6$ alkylene, C$_1$-C$_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—.

In some embodiments, X is —N(-L-R$^1$)—. In some embodiments, X is —N(R')—. In some embodiments, X is —N(R')—. In some embodiments, X is —N(R)—. In some embodiments, X is —NH—.

In some embodiments, X is L. In some embodiments, X is a covalent bond. In some embodiments, X is or an optionally substituted, linear or branched $C_1$-$C_{10}$ alkylene, wherein one or more methylene units of L are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—. In some embodiments, X is an optionally substituted $C_1$-$C_{10}$ alkylene or $C_1$-$C_{10}$ alkenylene. In some embodiments, X is methylene.

In some embodiments, Y is —O—. In some embodiments, Y is —S—.

In some embodiments, Y is —N(-L-R$^1$)—. In some embodiments, Y is —N(R')—. In some embodiments, Y is —N(R')—. In some embodiments, Y is —N(R)—. In some embodiments, Y is —NH—.

In some embodiments, Y is L. In some embodiments, Y is a covalent bond. In some embodiments, Y is or an optionally substituted, linear or branched $C_1$-$C_{10}$ alkylene, wherein one or more methylene units of L are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—. In some embodiments, Y is an optionally substituted $C_1$-$C_{10}$ alkylene or $C_1$-$C_{10}$ alkenylene. In some embodiments, Y is methylene.

In some embodiments, Z is —O—. In some embodiments, Z is —S—.

In some embodiments, Z is —N(-L-R$^1$)—. In some embodiments, Z is —N(R')—. In some embodiments, Z is —N(R')—. In some embodiments, Z is —N(R)—. In some embodiments, Z is —NH—.

In some embodiments, Z is L. In some embodiments, Z is a covalent bond. In some embodiments, Z is or an optionally substituted, linear or branched $C_1$-$C_{10}$ alkylene, wherein one or more methylene units of L are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—. In some embodiments, Z is an optionally substituted $C_1$-$C_{10}$ alkylene or $C_1$-$C_{10}$ alkenylene. In some embodiments, Z is methylene.

As defined generally above and herein, L is a covalent bond or an optionally substituted, linear or branched $C_1$-$C_{10}$ alkylene, wherein one or more methylene units of L are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—.

In some embodiments, L is a covalent bond. In some embodiments, L is an optionally substituted, linear or branched $C_1$-$C_{10}$ alkylene, wherein one or more methylene units of L are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—.

In some embodiments, L has the structure of -L$^1$-V—, wherein:

L$^1$ is an optionally substituted group selected from

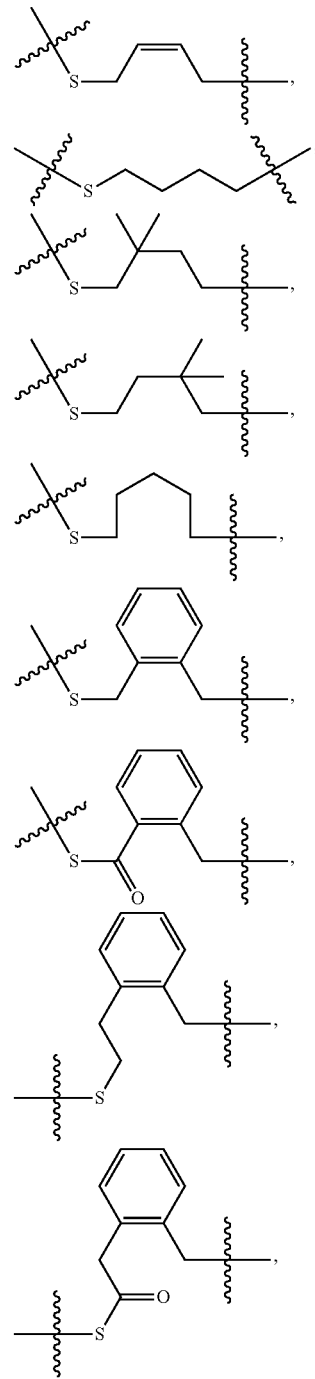

$C_1$-$C_6$ alkylene, $C_1$-$C_6$ alkenylene, carbocyclylene, arylene, $C_1$-$C_6$ heteroalkylene, heterocyclylene, and heteroarylene;

V is selected from —O—, —S—, —N'—, C(R')$_2$, —S—S—, —B—S—S—C—,

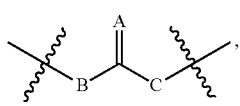

or an optionally substituted group selected from C$_1$-C$_6$ alkylene, arylene, C$_1$-C$_6$ heteroalkylene, heterocyclylene, and heteroarylene;
A is =O, =S, =NR', or =C(R')$_2$;
each of B and C is independently —O—, —S—, —N'—, —C(R')$_2$—, or an optionally substituted group selected from C$_1$-C$_6$ alkylene, carbocyclylene, arylene, heterocyclylene, or heteroarylene; and each R' is independently as defined above and described herein.

In some embodiments, L$^1$ is

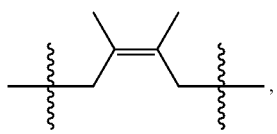

In some embodiments, L$^1$ is

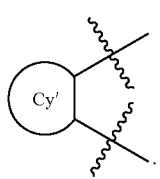 [SMILES: *CC*]

wherein Ring Cy' is an optionally substituted arylene, carbocyclylene, heteroarylene, or heterocyclylene. In some embodiments, L$^1$ is optionally substituted

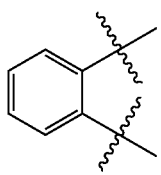

In some embodiments, L$^1$ is


In some embodiments, L$^1$ is connected to X. In some embodiments, L$^1$ is an optionally substituted group selected from

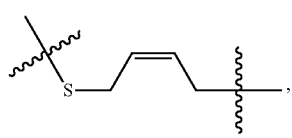

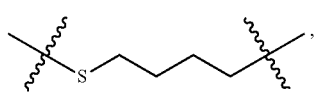

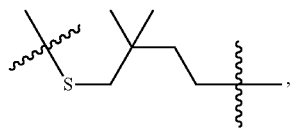

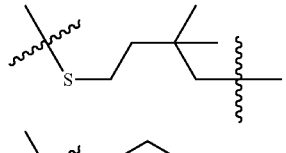

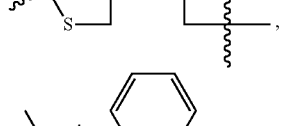

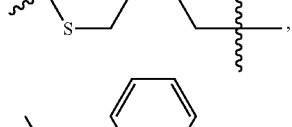

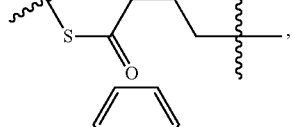

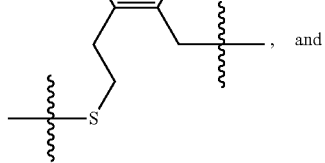

, and

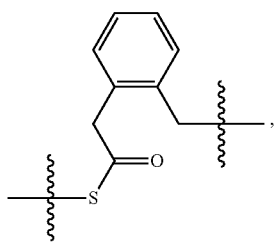

and the sulfur atom is connect to V. In some embodiments, $L^1$ is an optionally substituted group selected from

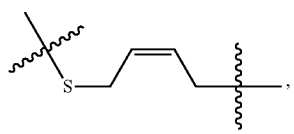

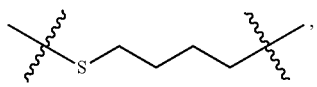

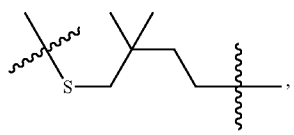

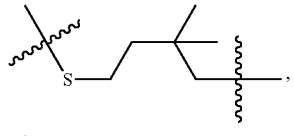

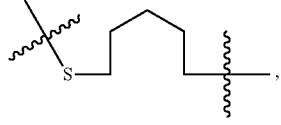

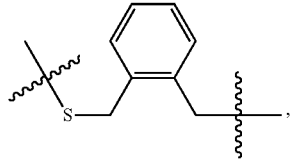

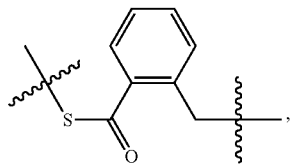

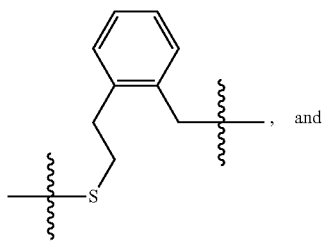, and

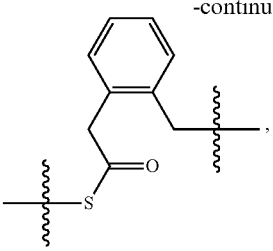

and the carbon atom is connect to X.

In some embodiments, L has the structure of:

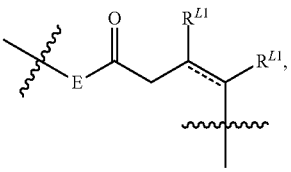

wherein:
E is —O—, —S—, —NR'— or —C(R')$_2$—;
==== is a single or double bond;
the two $R^{L1}$ are taken together with the two carbon atoms to which they are bound to form an optionally substituted aryl, carbocyclic, heteroaryl or heterocyclic ring; and each R' is independently as defined above and described herein.

In some embodiments, L has the structure of:

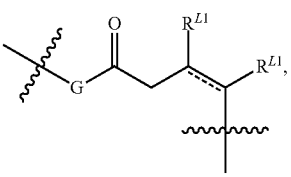

wherein:
G is —O—, —S—, or —NR'; ==== is a single or double bond; and
the two $R^{L1}$ are taken together with the two carbon atoms to which they are bound to form an optionally substituted aryl, $C_3$-$C_{10}$ carbocyclic, heteroaryl or heterocyclic ring.

In some embodiments, L has the structure of:

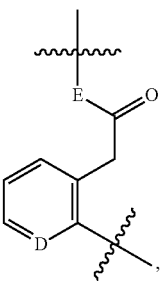

wherein:
E is —O—, —S—, —NR'— or —C(R')$_2$—;
D is =N—, =C(F)—, =C(Cl)—, =C(Br)—, =C(I)—, =C(CN)—, =C(NO$_2$)—, =C(CO$_2$—($C_1$-$C_6$ aliphatic))-, or =C(CF$_3$)—; and each R' is independently as defined above and described herein.

In some embodiments, L has the structure of:

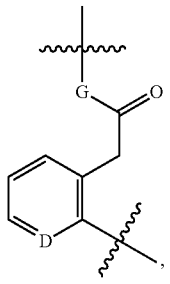

wherein:

G is —O—, —S—, or —NR';

D is =N—, =C(F)—, =C(Cl)—, =C(Br)—, =C(I)—, =C(CN)—, =C(NO$_2$)—, =C(CO$_2$—(C$_1$-C$_6$ aliphatic))-, or =C(CF$_3$)—.

In some embodiments, L has the structure of:

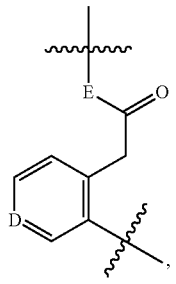

wherein:

E is —O—, —S—, —NR'— or —C(R')$_2$—;

D is =N—, =C(F)—, =C(Cl)—, =C(Br)—, =C(I)—, =C(CN)—, =C(NO$_2$)—, =C(CO$_2$—(C$_1$-C$_6$ aliphatic))-, or =C(CF$_3$)—; and each R' is independently as defined above and described herein.

In some embodiments, L has the structure of:

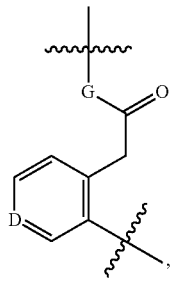

wherein:

G is —O—, —S—, or —NR';

D is =N—, =C(F)—, =C(Cl)—, =C(Br)—, =C(I)—, =C(CN)—, =C(NO$_2$)—, =C(CO$_2$—(C$_1$-C$_6$ aliphatic))-, or =C(CF$_3$)—.

In some embodiments, L has the structure of:

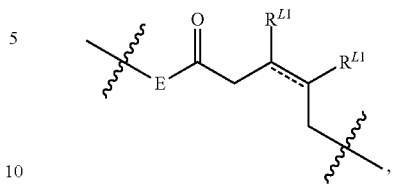

wherein:

E is —O—, —S—, —NR'— or —C(R')$_2$—; ==== is a single or double bond;

the two R$^{L1}$ are taken together with the two carbon atoms to which they are bound to form an optionally substituted aryl, C$_3$-C$_{10}$ carbocyclic, heteroaryl or heterocyclic ring; and each R' is independently as defined above and described herein.

In some embodiments, L has the structure of:

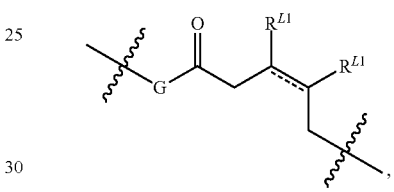

wherein:

G is —O—, —S—, or —NR';

==== is a single or double bond;

the two R$^{L1}$ are taken together with the two carbon atoms to which they are bound to form an optionally substituted aryl, C$_3$-C$_{10}$ carbocyclic, heteroaryl or heterocyclic ring;

and each R' is independently as defined above and described herein.

In some embodiments, L has the structure of:

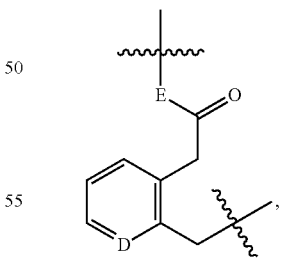

wherein:

E is —O—, —S—, —NR'— or —C(R')$_2$—;

D is =N—, =C(F)—, =C(Cl)—, =C(Br)—, =C(I)—, =C(CN)—, =C(NO$_2$)—, =C(CO$_2$—(C$_1$-C$_6$ aliphatic))-, or =C(CF$_3$)—; and each R' is independently as defined above and described herein.

In some embodiments, L has the structure of:

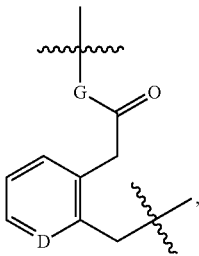

wherein:

G is —O—, —S—, or —NR';

D is =N—, =C(F)—, =C(Cl)—, =C(Br)—, =C(I)—, =C(CN)—, =C(NO$_2$)—, =C(CO$_2$—(C$_1$-C$_6$ aliphatic))-, or =C(CF$_3$)—; and each R' is independently as defined above and described herein.

In some embodiments, L has the structure of:

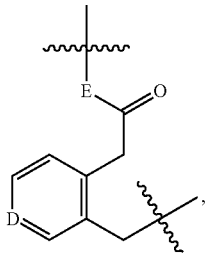

wherein:

E is —O—, —S—, —NR'— or —C(R')$_2$—;

D is =N—, =C(F)—, =C(Cl)—, =C(Br)—, =C(I)—, =C(CN)—, =C(NO$_2$)—, =C(CO$_2$—(C$_1$-C$_6$ aliphatic))-, or =C(CF$_3$)—; and each R' is independently as defined above and described herein.

In some embodiments, L has the structure of:

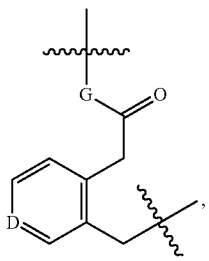

wherein:

G is —O—, —S—, or —NR';

D is =N—, =C(F)—, =C(Cl)—, =C(Br)—, =C(I)—, =C(CN)—, =C(NO$_2$)—, =C(CO$_2$—(C$_1$-C$_6$ aliphatic))-, or =C(CF$_3$)—; and each R' is independently as defined above and described herein.

In some embodiments, L has the structure of:

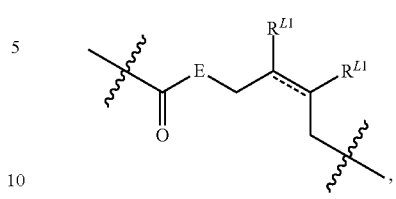

wherein:

E is —O—, —S—, —NR'— or —C(R')$_2$—;

==== is a single or double bond;

the two $R^{L1}$ are taken together with the two carbon atoms to which they are bound to form an optionally substituted aryl, C$_3$-C$_{10}$ carbocyclic, heteroaryl or heterocyclic ring; and each R' is independently as defined above and described herein.

In some embodiments, L has the structure of:

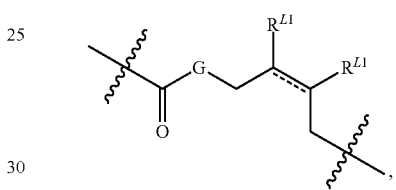

wherein:

G is —O—, —S—, or —NR';

==== is a single or double bond;

the two $R^{L1}$ are taken together with the two carbon atoms to which they are bound to form an optionally substituted aryl, C$_3$-C$_{10}$ carbocyclic, heteroaryl or heterocyclic ring; and each R' is independently as defined above and described herein.

In some embodiments, L has the structure of:

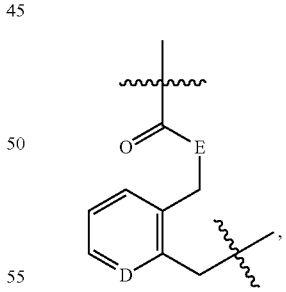

wherein:

E is —O—, —S—, —NR'— or —C(R')$_2$—;

D is =N—, =C(F)—, =C(Cl)—, =C(Br)—, =C(I)—, =C(CN)—, =C(NO$_2$)—, =C(CO$_2$—(C$_1$-C$_6$ aliphatic))-, or =C(CF$_3$)—; and each R' is independently as defined above and described herein.

In some embodiments, L has the structure of:

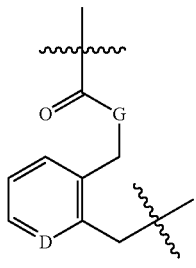

wherein:

G is —O—, —S—, or —NR';

D is =N—, =C(F)—, =C(Cl)—, =C(Br)—, =C(I)—, =C(CN)—, =C(NO$_2$)—, =C(CO$_2$—(C$_1$-C$_6$ aliphatic))-, or =C(CF$_3$)—; and R' is as defined above and described herein.

In some embodiments, L has the structure of:

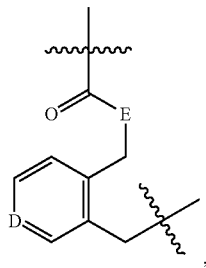

wherein:

E is —O—, —S—, —NR'— or —C(R')$_2$—;

D is =N—, =C(F)—, =C(Cl)—, =C(Br)—, =C(I)—, =C(CN)—, =C(NO$_2$)—, =C(CO$_2$—(C$_6$-C$_6$ aliphatic))-, or =C(CF$_3$)—; and each R' is independently as defined above and described herein.

In some embodiments, L has the structure of:

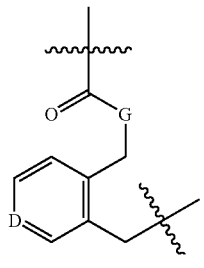

wherein:

G is —O—, —S—, or —NR';

D is =N—, =C(F)—, =C(Cl)—, =C(Br)—, =C(I)—, =C(CN)—, =C(NO$_2$)—, =C(CO$_2$—(C$_1$-C$_6$ aliphatic))-, or =C(CF$_3$)—; and R' is as defined above and described herein.

In some embodiments, L has the structure of:

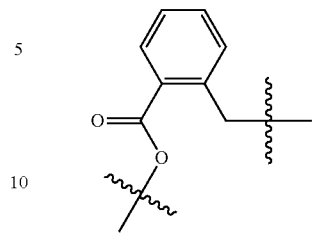

wherein the phenyl ring is optionally substituted. In some embodiments, the phenyl ring is not substituted. In some embodiments, the phenyl ring is substituted.

In some embodiments, L has the structure of:

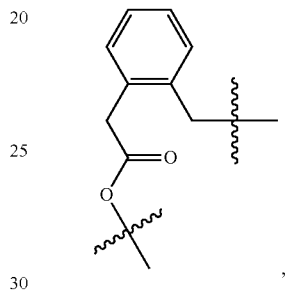

wherein the phenyl ring is optionally substituted. In some embodiments, the phenyl ring is not substituted. In some embodiments, the phenyl ring is substituted.

In some embodiments, L has the structure of:

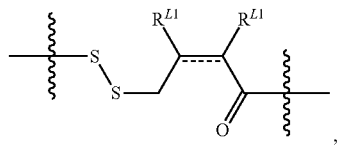

wherein:

==== is a single or double bond; and the two $R^{L1}$ are taken together with the two carbon atoms to which they are bound to form an optionally substituted aryl, C$_3$-C$_{10}$ carbocyclic, heteroaryl or heterocyclic ring.

In some embodiments, L has the structure of:

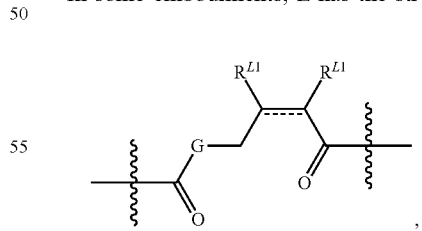

wherein:

G is —O—, —S—, or —NR';

==== is a single or double bond; and the two $R^{L1}$ are taken together with the two carbon atoms to which they are bound to form an optionally substituted aryl, C$_3$-C$_{10}$ carbocyclic, heteroaryl or heterocyclic ring.

As defined generally above and herein, E is —O—, —S—, —NR'— or —C(R')$_2$—, wherein each R' independently as defined above and described herein. In some embodiments, E is —O—, —S—, or —NR'—. In some embodiments, E is —O—, —S—, or —NH—. In some embodiments, E is —O—. In some embodiments, E is —S—. In some embodiments, E is —NH—.

As defined generally above and herein, G is —O—, —S—, or —NR', wherein each R' independently as defined above and described herein. In some embodiments, G is —O—, —S—, or —NH—. In some embodiments, G is —O—. In some embodiments, G is —S—. In some embodiments, G is —NH—.

In some embodiments, L is -L³-G-, wherein:
L³ is an optionally substituted C₁-C₅ alkylene or alkenylene, wherein one or more methylene units are optionally and independently replaced by —O—, —S—, —N(R')—, —C(O)—, —C(S)—, —C(NR')—, —S(O)—, —S(O)₂—, or

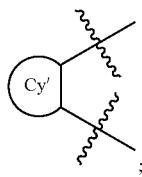 [SMILES: *CC*]
;

and
wherein each of G, R' and Ring Cy' is independently as defined above and described herein.

In some embodiments, L is -L³-S—, wherein L³ is as defined above and described herein. In some embodiments, L is -L³-O—, wherein L³ is as defined above and described herein. In some embodiments, L is -L³-N(R')—, wherein each of L³ and R' is independently as defined above and described herein. In some embodiments, L is -L³-NH—, wherein each of L³ and R' is independently as defined above and described herein.

In some embodiments, L³ is an optionally substituted C₅ alkylene or alkenylene, wherein one or more methylene units are optionally and independently replaced by —O—, —S—, —N(R')—, —C(O)—, —C(S)—, —C(NR')—, —S(O)—, —S(O)₂—, or

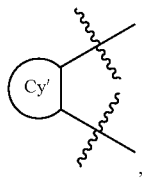
, and each of R' and Ring Cy' is independently as defined above and described herein. In some embodiments, L³ is an optionally substituted C₅ alkylene. In some embodiments, -L³-G- is

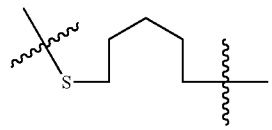

In some embodiments, L³ is an optionally substituted C₄ alkylene or alkenylene, wherein one or more methylene units are optionally and independently replaced by —O—, —S—, —N(R')—, —C(O)—, —C(S)—, —C(NR')—, —S(O)—, —S(O)₂—, or

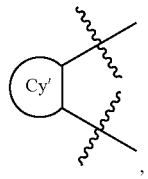 [SMILES: *CC*]
, and each of R' and Cy' is independently as defined above and described herein.

In some embodiments, -L³-G- is

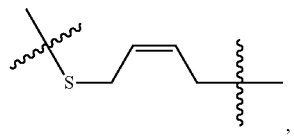
,

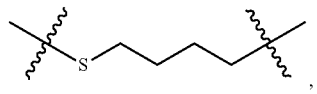
,

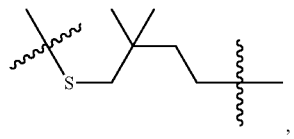
,

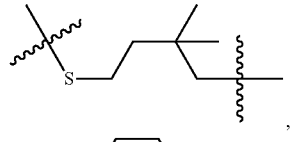
,

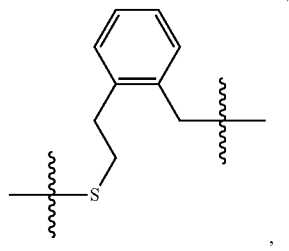
,

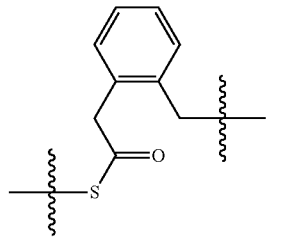 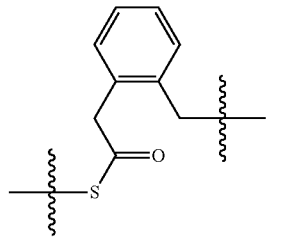

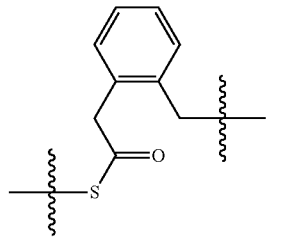 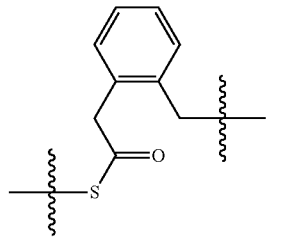
, or

In some embodiments, L³ is an optionally substituted C₃ alkylene or alkenylene, wherein one or more methylene units are optionally and independently replaced by —O—, —S—, —N(R')—, —C(O)—, —C(S)—, —C(NR')—, —S(O)—, —S(O)$_2$—, or

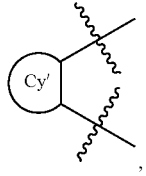 [SMILES: *CC*]

, and each of R' and Cy' is independently as defined above and described herein.

In some embodiments, -L$^3$-G- is

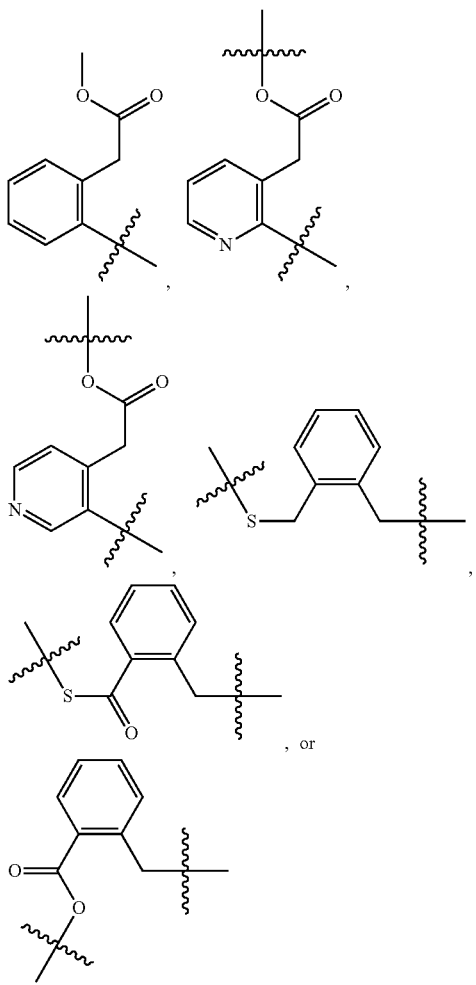

, or

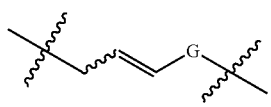

.

In some embodiments, L is

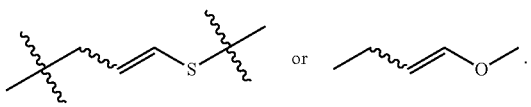

In some embodiments, L is

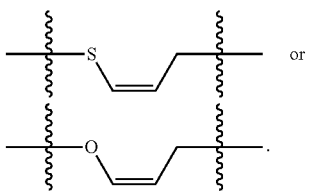

In some embodiments, L is

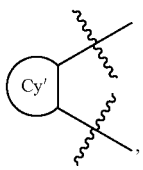 [SMILES: *CC*]

or

In some embodiments, L$^3$ is an optionally substituted C$_2$ alkylene or alkenylene, wherein one or more methylene units are optionally and independently replaced by —O—, —S—, —N(R')—, —C(O)—, —C(S)—, —C(NR')—, —S(O)—, —S(O)$_2$—, or

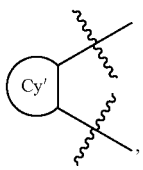 [SMILES: *CC*]

, and each of R' and Cy' is independently as defined above and described herein.

In some embodiments, -L$^3$-G- is

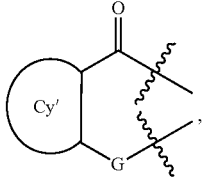

, wherein each of G and Cy' is independently as defined above and described herein. In some embodiments, L is

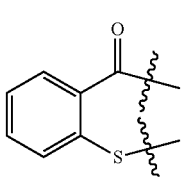

.

In some embodiments, L is -L$^4$-G-, wherein L$^4$ is an optionally substituted C$_1$-C$_2$ alkylene; and G is as defined above and described herein. In some embodiments, L is -L$^4$-G-, wherein L$^4$ is an optionally substituted C$_1$-C$_2$ alkylene; G is as defined above and described herein; and G is connected to R$^1$. In some embodiments, L is -L$^4$-G-, wherein L$^4$ is an optionally substituted methylene; G is as defined above and described herein; and G is connected to R$^1$. In some embodiments, L is -L$^4$-G-, wherein L$^4$ is methylene; G is as defined above and described herein; and G is connected to R¹. In some embodiments, L is -L⁴-G-, wherein L⁴ is an optionally substituted —(CH₂)₂—; G is as defined above and described herein; and G is connected to R¹. In some embodiments, L is -L⁴-G-, wherein L⁴ is —(CH₂)₂—; G is as defined above and described herein; and G is connected to R¹.

In some embodiments, L is

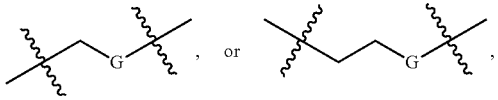

wherein G is as defined above and described herein, and G is connected to R¹. In some embodiments, L is

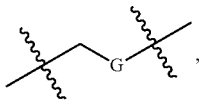

wherein G is as defined above and described herein, and G is connected to R¹. In some embodiments, L is

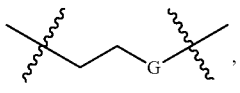

wherein G is as defined above and described herein, and G is connected to R¹. In some embodiments, L is

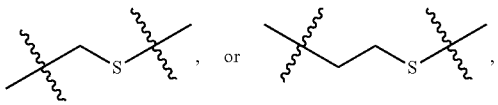

wherein the sulfur atom is connected to R¹. In some embodiments, L is

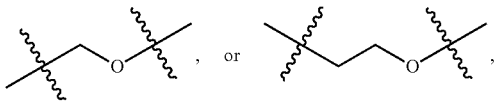

wherein the oxygen atom is connected to R¹.

In some embodiments, L is

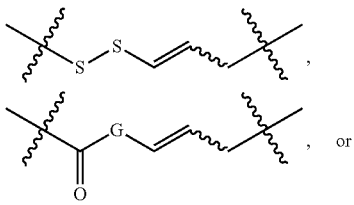

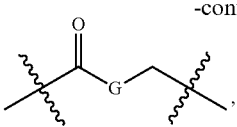

wherein G is as defined above and described herein.

In some embodiments, L is —S—$R^{L3}$— or —S—C(O)—$R^{L3}$—, wherein $R^{L3}$ is an optionally substituted, linear or branched, $C_1$-$C_9$ alkylene, wherein one or more methylene units are optionally and independently replaced by an optionally substituted $C_1$-$C_6$ alkylene, $C_1$-$C_6$ alkenylene, —C≡C—, —C(R')₂—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)₂—, —S(O)₂N(R')—, —N(R')S(O)₂—, —SC(O)—, —C(O)S—, —OC(O)—, or —C(O)O—, wherein each of R' and -Cy- is independently as defined above and described herein. In some embodiments, L is —S—$R^{L3}$— or —S—C(O)—$R^{L3}$—, wherein $R^{L3}$ is an optionally substituted $C_1$-$C_6$ alkylene. In some embodiments, L is —S—$R^{L3}$— or —S—C(O)—$R^{L3}$—, wherein $R^{L3}$ is an optionally substituted $C_1$-$C_6$ alkenylene. In some embodiments, L is —S—$R^{L3}$— or —S—C(O)—$R^{L3}$—, wherein $R^{L3}$ is an optionally substituted $C_1$-$C_6$ alkylene wherein one or more methylene units are optionally and independently replaced by an optionally substituted $C_1$-$C_6$ alkenylene, arylene, or heteroarylene. In some embodiments, $R^{L3}$ is an optionally substituted —S—($C_1$-$C_6$ alkenylene)-, —S—($C_1$-$C_6$ alkylene)-, —S—($C_1$-$C_6$ alkylene)-arylene-($C_1$-$C_6$ alkylene)-, —S—CO-arylene-($C_1$-$C_6$ alkylene)-, or —S—CO—($C_1$-$C_6$ alkylene)-arylene-($C_1$-$C_6$ alkylene)-.

In some embodiments, L is


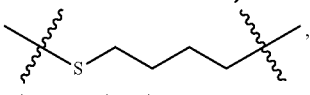

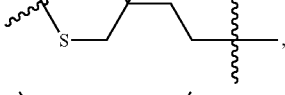

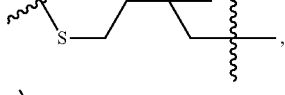

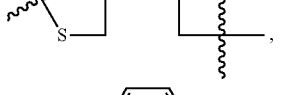

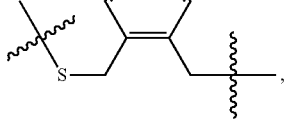

-continued

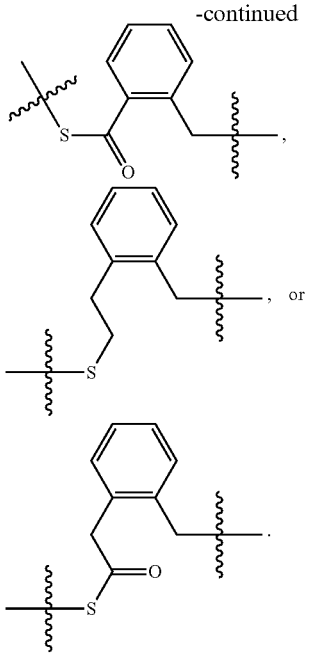

In some embodiments, L is

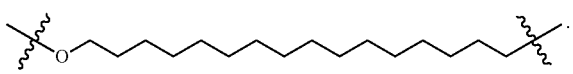 [SMILES: *CCCCCCCCCCCCCCCCO*]

In some embodiments, L is

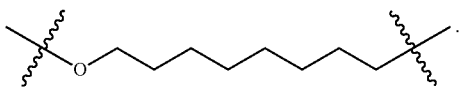 [SMILES: *CCCCCCCCO*]

In some embodiments,

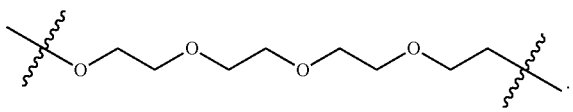 [SMILES: *CCOCCOCCOCCO*]

In some embodiments, the sulfur atom in the L embodiments described above and herein is connected to X. In some embodiments, the sulfur atom in the L embodiments described above and herein is connected to $R^1$.

As defined generally above and herein, $R^1$ is halogen, R, or an optionally substituted $C_1$-$C_{50}$ aliphatic wherein one or more methylene units are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—, wherein each variable is independently as defined above and described herein. In some embodiments, R' is halogen, R, or an optionally substituted $C_1$-$C_{10}$ aliphatic wherein one or more methylene units are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—, wherein each variable is independently as defined above and described herein.

In some embodiments, $R^1$ is hydrogen. In some embodiments, $R^1$ is halogen. In some embodiments, $R^1$ is —F. In some embodiments, $R^1$ is —Cl. In some embodiments, $R^1$ is —Br. In some embodiments, $R^1$ is —I.

In some embodiments, $R^1$ is R wherein R is as defined above and described herein.

In some embodiments, $R^1$ is hydrogen. In some embodiments, $R^1$ is an optionally substituted group selected from $C_1$-$C_{50}$ aliphatic, phenyl, carbocyclyl, aryl, heteroaryl, or heterocyclyl.

In some embodiments, $R^1$ is an optionally substituted $C_1$-$C_{50}$ aliphatic. In some embodiments, $R^1$ is an optionally substituted $C_1$-$C_{10}$ aliphatic. In some embodiments, $R^1$ is an optionally substituted $C_1$-$C_6$ aliphatic. In some embodiments, $R^1$ is an optionally substituted $C_1$-$C_6$ alkyl. In some embodiments, $R^1$ is optionally substituted, linear or branched hexyl. In some embodiments, $R^1$ is optionally substituted, linear or branched pentyl. In some embodiments, $R^1$ is optionally substituted, linear or branched butyl. In some embodiments, $R^1$ is optionally substituted, linear or branched propyl. In some embodiments, $R^1$ is optionally substituted ethyl. In some embodiments, $R^1$ is optionally substituted methyl.

In some embodiments, $R^1$ is optionally substituted phenyl. In some embodiments, $R^1$ is substituted phenyl. In some embodiments, $R^1$ is phenyl.

In some embodiments, $R^1$ is optionally substituted carbocyclyl. In some embodiments, $R^1$ is optionally substituted $C_3$-$C_{10}$ carbocyclyl. In some embodiments, $R^1$ is optionally substituted monocyclic carbocyclyl. In some embodiments, $R^1$ is optionally substituted cycloheptyl. In some embodiments, $R^1$ is optionally substituted cyclohexyl. In some embodiments, $R^1$ is optionally substituted cyclopentyl. In some embodiments, $R^1$ is optionally substituted cyclobutyl. In some embodiments, $R^1$ is an optionally substituted cyclopropyl. In some embodiments, $R^1$ is optionally substituted bicyclic carbocyclyl.

In some embodiments, $R^1$ is an optionally substituted $C_1$-$C_{50}$ polycyclic hydrocarbon. In some embodiments, $R^1$ is an optionally substituted $C_1$-$C_{50}$ polycyclic hydrocarbon wherein one or more methylene units are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—, wherein each variable is independently as defined above and described herein. In some embodiments, $R^1$ is optionally substituted

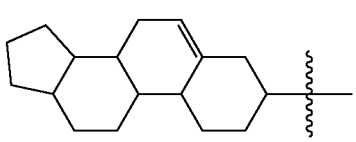

In some embodiments, $R^1$ is

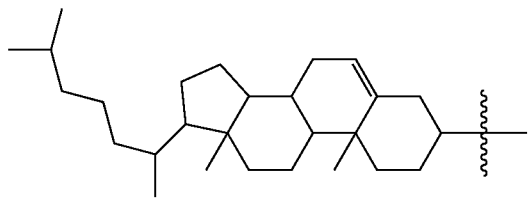

In some embodiments, $R^1$ is optionally substituted

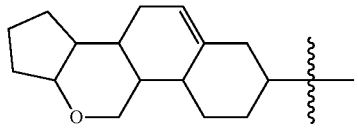

In some embodiments, $R^1$ is an optionally substituted $C_1$-$C_{50}$ aliphatic comprising one or more optionally substituted polycyclic hydrocarbon moieties. In some embodiments, $R^1$ is an optionally substituted $C_1$-$C_{50}$ aliphatic comprising one or more optionally substituted polycyclic hydrocarbon moieties, wherein one or more methylene units are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—, wherein each variable is independently as defined above and described herein. In some embodiments, $R^1$ is an optionally substituted $C_1$-$C_{50}$ aliphatic comprising one or more optionally substituted

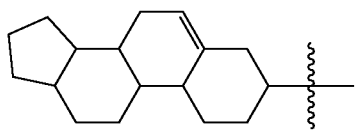

,

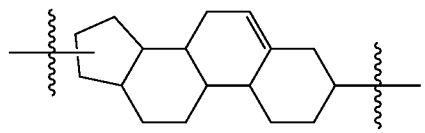

,

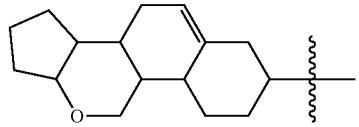

, or

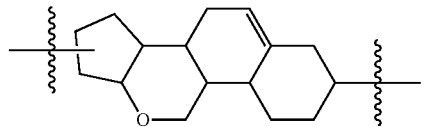

.

In some embodiments, $R^1$ is

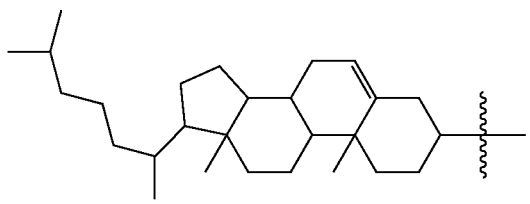

In some embodiments, $R^1$ is

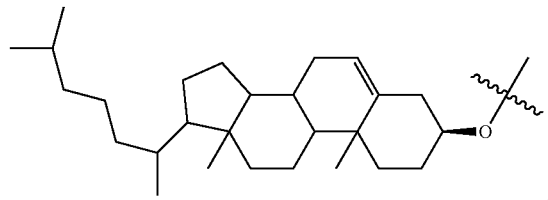

In some embodiments, $R^1$ is

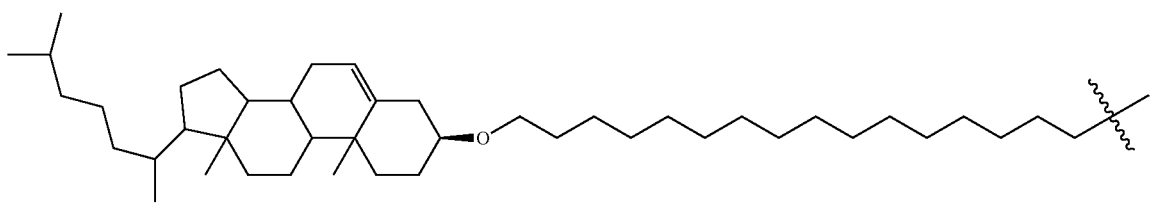

In some embodiments, R¹ is

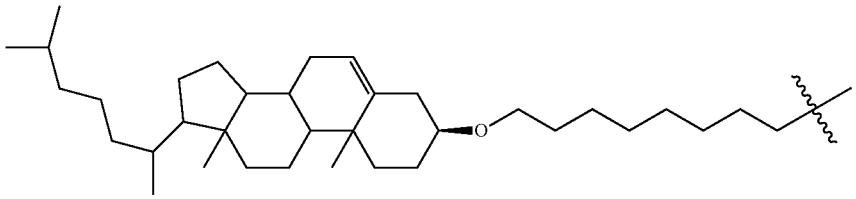

In some embodiments, R¹ is

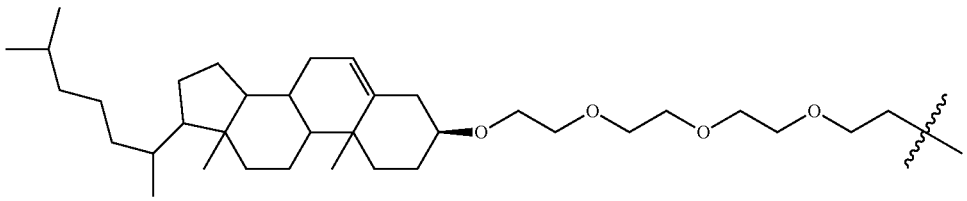

In some embodiments, R¹ is an optionally substituted aryl. In some embodiments, R¹ is an optionally substituted bicyclic aryl ring.

In some embodiments, R¹ is an optionally substituted heteroaryl. In some embodiments, R¹ is an optionally substituted 5-6 membered monocyclic heteroaryl ring having 1-3 heteroatoms independently selected from nitrogen, sulfur, or oxygen. In some embodiments, R¹ is a substituted 5-6 membered monocyclic heteroaryl ring having 1-3 heteroatoms independently selected from nitrogen, oxygen, or sulfur. In some embodiments, R¹ is an unsubstituted 5-6 membered monocyclic heteroaryl ring having 1-3 heteroatoms independently selected from nitrogen, sulfur, or oxygen.

In some embodiments, R¹ is an optionally substituted 5 membered monocyclic heteroaryl ring having 1-3 heteroatoms independently selected from nitrogen, oxygen or sulfur. In some embodiments, R¹ is an optionally substituted 6 membered monocyclic heteroaryl ring having 1-3 heteroatoms independently selected from nitrogen, oxygen, or sulfur.

In some embodiments, R¹ is an optionally substituted 5-membered monocyclic heteroaryl ring having 1 heteroatom selected from nitrogen, oxygen, or sulfur. In some embodiments, R¹ is selected from pyrrolyl, furanyl, or thienyl.

In some embodiments, R¹ is an optionally substituted 5-membered heteroaryl ring having 2 heteroatoms independently selected from nitrogen, oxygen, or sulfur. In certain embodiments, R¹ is an optionally substituted 5-membered heteroaryl ring having 1 nitrogen atom, and an additional heteroatom selected from sulfur or oxygen. Exemplary R¹ groups include optionally substituted pyrazolyl, imidazolyl, thiazolyl, isothiazolyl, oxazolyl or isoxazolyl.

In some embodiments, R¹ is a 6-membered heteroaryl ring having 1-3 nitrogen atoms. In other embodiments, R¹ is an optionally substituted 6-membered heteroaryl ring having 1-2 nitrogen atoms. In some embodiments, R¹ is an optionally substituted 6-membered heteroaryl ring having 2 nitrogen atoms. In certain embodiments, R¹ is an optionally substituted 6-membered heteroaryl ring having 1 nitrogen. Exemplary R¹ groups include optionally substituted pyridinyl, pyrimidinyl, pyrazinyl, pyridazinyl, triazinyl, or tetrazinyl.

In certain embodiments, R¹ is an optionally substituted 8-10 membered bicyclic heteroaryl ring having 1-4 heteroatoms independently selected from nitrogen, oxygen, or sulfur. In some embodiments, R¹ is an optionally substituted 5,6-fused heteroaryl ring having 1-4 heteroatoms independently selected from nitrogen, oxygen, or sulfur. In other embodiments, R¹ is an optionally substituted 5,6-fused heteroaryl ring having 1-2 heteroatoms independently selected from nitrogen, oxygen, or sulfur. In certain embodiments, R¹ is an optionally substituted 5,6-fused heteroaryl ring having 1 heteroatom independently selected from nitrogen, oxygen, or sulfur. In some embodiments, R¹ is an optionally substituted indolyl. In some embodiments, R¹ is an optionally substituted azabicyclo[3.2.1]octanyl. In certain embodiments, R¹ is an optionally substituted 5,6-fused heteroaryl ring having 2 heteroatoms independently selected from nitrogen, oxygen, or sulfur. In some embodiments, R¹ is an optionally substituted azaindolyl. In some embodiments, R¹ is an optionally substituted benzimidazolyl. In some embodiments, R¹ is an optionally substituted benzothiazolyl. In some embodiments, R¹ is an optionally substituted benzoxazolyl. In some embodiments, R¹ is an optionally substituted indazolyl. In certain embodiments, R¹ is an optionally substituted 5,6-fused heteroaryl ring having 3 heteroatoms independently selected from nitrogen, oxygen, or sulfur.

In certain embodiments, R¹ is an optionally substituted 6,6-fused heteroaryl ring having 1-4 heteroatoms independently selected from nitrogen, oxygen, or sulfur. In some embodiments, R¹ is an optionally substituted 6,6-fused heteroaryl ring having 1-2 heteroatoms independently selected from nitrogen, oxygen, or sulfur. In other embodiments, R¹ is an optionally substituted 6,6-fused heteroaryl ring having 1 heteroatom independently selected from nitrogen, oxygen, or sulfur. In some embodiments, R¹ is an optionally substituted quinolinyl. In some embodiments, R¹ is an optionally substituted isoquinolinyl. According to one aspect, R¹ is an optionally substituted 6,6-fused heteroaryl ring having 2 heteroatoms independently selected from nitrogen, oxygen, or sulfur. In some embodiments, R¹ is a quinazoline or a quinoxaline.

In some embodiments, $R^1$ is an optionally substituted heterocyclyl. In some embodiments, $R^1$ is an optionally substituted 3-7 membered saturated or partially unsaturated heterocyclic ring having 1-2 heteroatoms independently selected from nitrogen, oxygen, or sulfur. In some embodiments, $R^1$ is a substituted 3-7 membered saturated or partially unsaturated heterocyclic ring having 1-2 heteroatoms independently selected from nitrogen, oxygen, or sulfur. In some embodiments, $R^1$ is an unsubstituted 3-7 membered saturated or partially unsaturated heterocyclic ring having 1-2 heteroatoms independently selected from nitrogen, oxygen, or sulfur.

In some embodiments, $R^1$ is an optionally substituted heterocyclyl. In some embodiments, $R^1$ is an optionally substituted 6 membered saturated or partially unsaturated heterocyclic ring having 1-2 heteroatoms independently selected from nitrogen, oxygen, or sulfur. In some embodiments, $R^1$ is an optionally substituted 6 membered partially unsaturated heterocyclic ring having 2 heteroatoms independently selected from nitrogen, oxygen, or sulfur. In some embodiments, $R^1$ is an optionally substituted 6 membered partially unsaturated heterocyclic ring having 2 oxygen atoms.

In certain embodiments, $R^1$ is a 3-7 membered saturated or partially unsaturated heterocyclic ring having 1-2 heteroatoms independently selected from nitrogen, oxygen, or sulfur. In certain embodiments, $R^1$ is oxiranyl, oxetanyl, tetrahydrofuranyl, tetrahydropyranyl, oxepaneyl, aziridineyl, azetidineyl, pyrrolidinyl, piperidinyl, azepanyl, thiiranyl, thietanyl, tetrahydrothiophenyl, tetrahydrothiopyranyl, thiepanyl, dioxolanyl, oxathiolanyl, oxazolidinyl, imidazolidinyl, thiazolidinyl, dithiolanyl, dioxanyl, morpholinyl, oxathianyl, piperazinyl, thiomorpholinyl, dithianyl, dioxepanyl, oxazepanyl, oxathiepanyl, dithiepanyl, diazepanyl, dihydrofuranonyl, tetrahydropyranonyl, oxepanonyl, pyrolidinonyl, piperidinonyl, azepanonyl, dihydrothiophenonyl, tetrahydrothiopyranonyl, thiepanonyl, oxazolidinonyl, oxazinanonyl, oxazepanonyl, dioxolanonyl, dioxanonyl, dioxepanonyl, oxathiolinonyl, oxathianonyl, oxathiepanonyl, thiazolidinonyl, thiazinanonyl, thiazepanonyl, imidazolidinonyl, tetrahydropyrimidinonyl, diazepanonyl, imidazolidinedionyl, oxazolidinedionyl, thiazolidinedionyl, dioxolanedionyl, oxathiolanedionyl, piperazinedionyl, morpholinedionyl, thiomorpholinedionyl, tetrahydropyranyl, tetrahydrofuranyl, morpholinyl, thiomorpholinyl, piperidinyl, piperazinyl, pyrrolidinyl, tetrahydrothiophenyl, or tetrahydrothiopyranyl. In some embodiments, $R^1$ is an optionally substituted 5 membered saturated or partially unsaturated heterocyclic ring having 1-2 heteroatoms independently selected from nitrogen, oxygen, or sulfur.

In certain embodiments, $R^1$ is an optionally substituted 5-6 membered partially unsaturated monocyclic ring having 1-2 heteroatoms independently selected from nitrogen, oxygen, or sulfur. In certain embodiments, $R^1$ is an optionally substituted tetrahydropyridinyl, dihydrothiazolyl, dihydrooxazolyl, or oxazolinyl group.

In some embodiments, $R^1$ is an optionally substituted 8-10 membered bicyclic saturated or partially unsaturated heterocyclic ring having 1-4 heteroatoms independently selected from nitrogen, oxygen, or sulfur. In some embodiments, $R^1$ is an optionally substituted indolinyl. In some embodiments, $R^1$ is an optionally substituted isoindolinyl. In some embodiments, $R^1$ is an optionally substituted 1, 2, 3, 4-tetrahydroquinoline. In some embodiments, $R^1$ is an optionally substituted 1, 2, 3, 4-tetrahydroisoquinoline.

In some embodiments, $R^1$ is an optionally substituted $C_1$-$C_{10}$ aliphatic wherein one or more methylene units are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—, wherein each variable is independently as defined above and described herein. In some embodiments, $R^1$ is an optionally substituted $C_1$-$C_{10}$ aliphatic wherein one or more methylene units are optionally and independently replaced by an optionally-Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —OC(O)—, or —C(O)O—, wherein each $R^1$ is independently as defined above and described herein. In some embodiments, $R^1$ is an optionally substituted $C_1$-$C_{10}$ aliphatic wherein one or more methylene units are optionally and independently replaced by an optionally-Cy-, —O—, —S—, —S—S—, —N(R')—, —C(O)—, —OC(O)—, or —C(O)O—, wherein each R' is independently as defined above and described herein.

In some embodiments, $R^1$ is

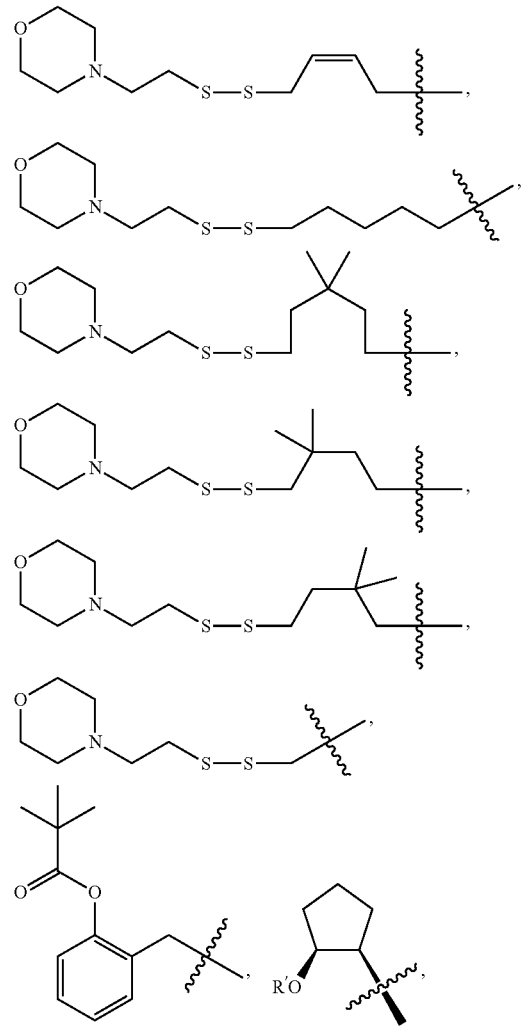

77
-continued
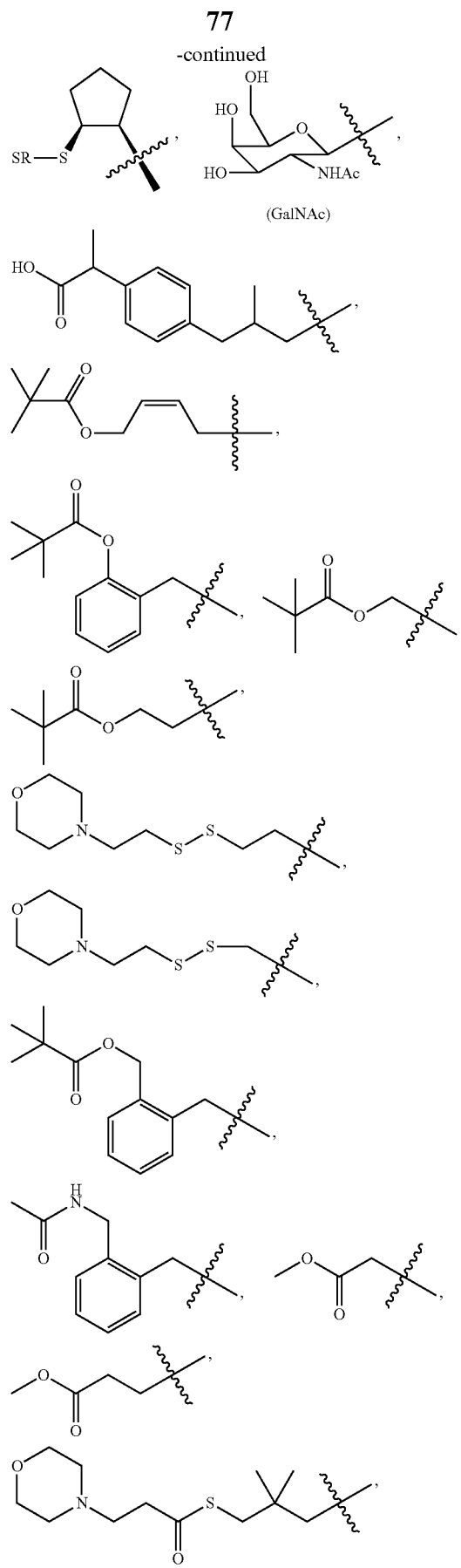
78
-continued
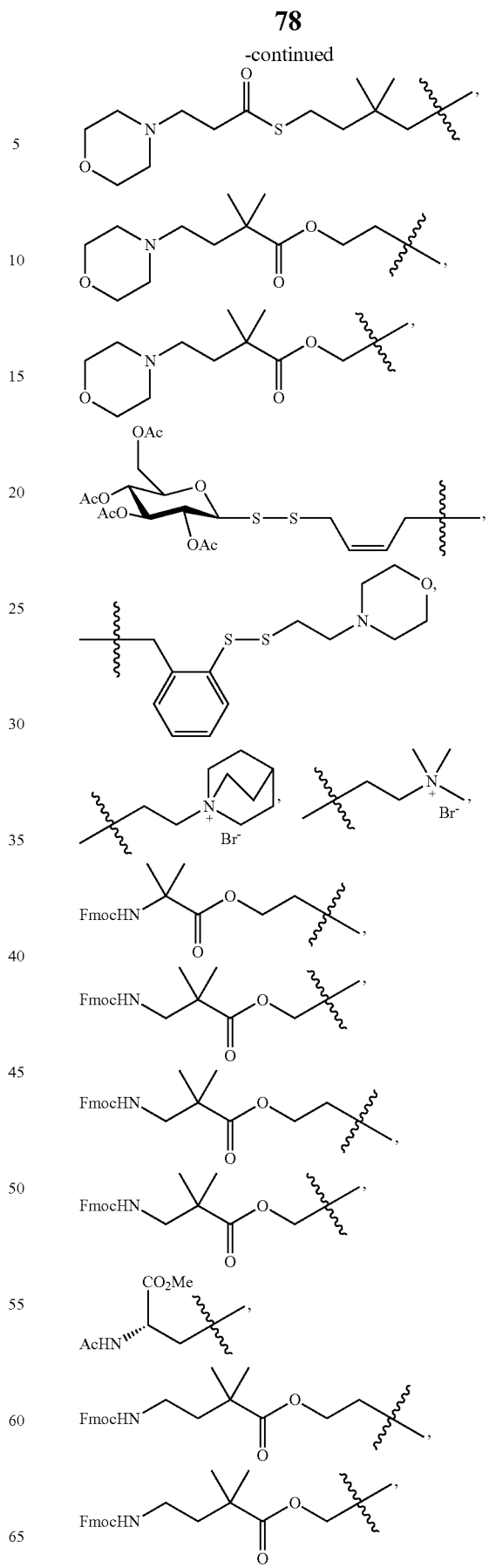

-continued

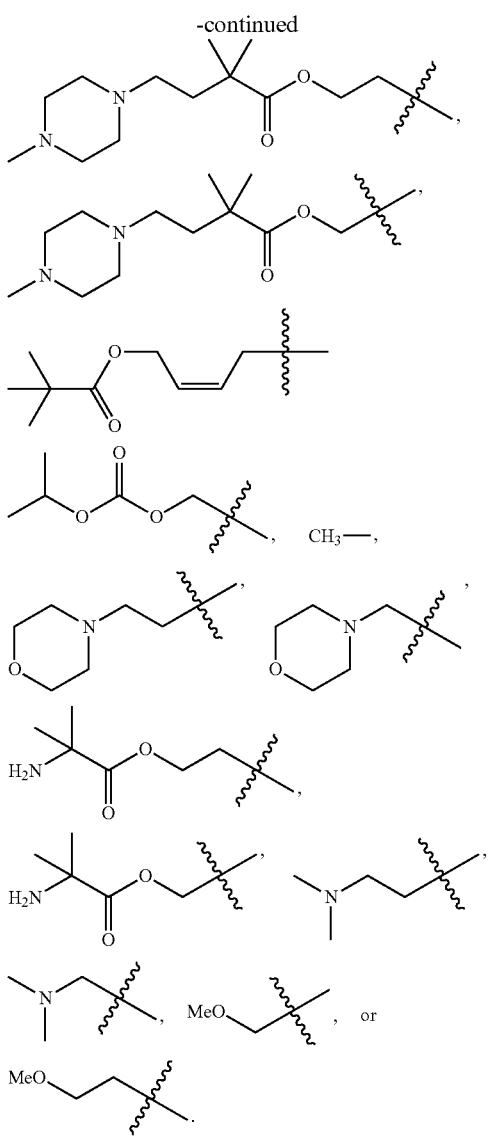

In some embodiments, $R^1$ is $CH_3$—,

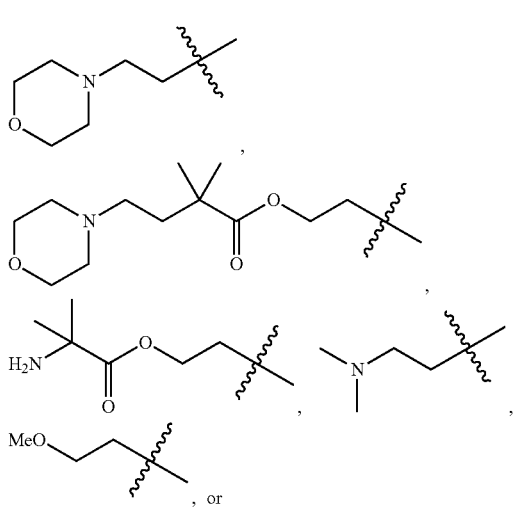, or

-continued

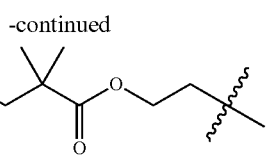

In some embodiments, $R^1$ comprises a terminal optionally substituted —$(CH_2)_2$— moiety which is connected to L. Exemplary such $R^1$ groups are depicted below:

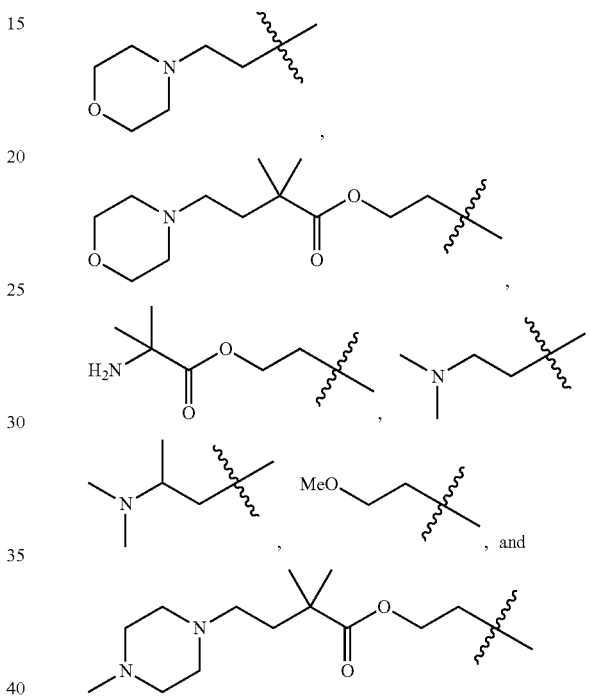, and

In some embodiments, $R^1$ comprises a terminal optionally substituted —$(CH_2)$— moiety which is connected to L. Exemplary such R' groups are depicted below:

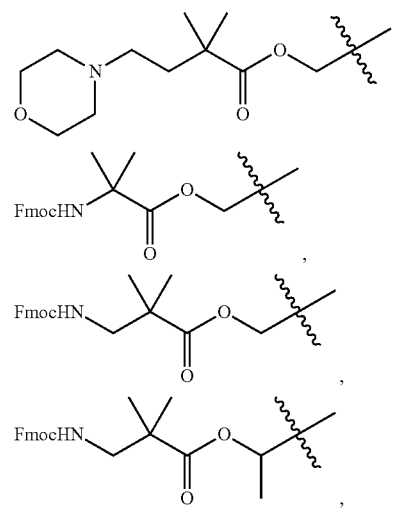,

-continued

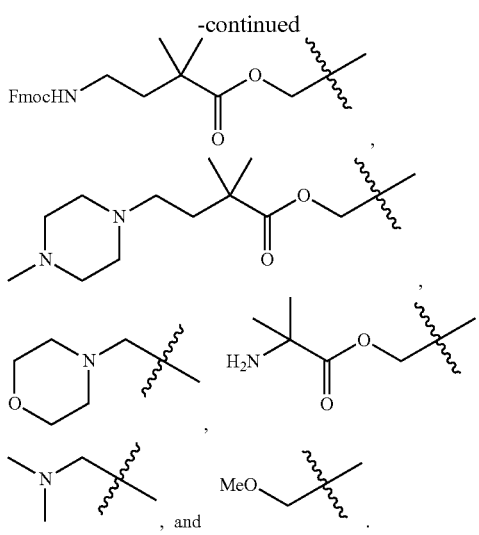

In some embodiments, $R^1$ is —S—$R^{L2}$, wherein $R^{L2}$ is an optionally substituted $C_1$-$C_9$ aliphatic wherein one or more methylene units are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—, and each of R' and -Cy- is independently as defined above and described herein. In some embodiments, $R^1$ is —S—$R^{L2}$, wherein the sulfur atom is connected with the sulfur atom in L group.

In some embodiments, $R^1$ is —C(O)—$R^{L2}$, wherein $R^{L2}$ is an optionally substituted $C_1$-$C_9$ aliphatic wherein one or more methylene units are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—, and each of R' and -Cy- is independently as defined above and described herein. In some embodiments, R' is —C(O)—$R^{L2}$, wherein the carbonyl group is connected with G in L group. In some embodiments, $R^1$ is —C(O)—$R^{L2}$, wherein the carbonyl group is connected with the sulfur atom in L group.

In some embodiments, $R^{L2}$ is optionally substituted $C_1$-$C_9$ aliphatic. In some embodiments, $R^{L2}$ is optionally substituted $C_1$-$C_9$ alkyl. In some embodiments, $R^{L2}$ is optionally substituted $C_1$-$C_9$ alkenyl. In some embodiments, $R^{L2}$ is optionally substituted $C_1$-$C_9$ alkynyl. In some embodiments, $R^{L2}$ is an optionally substituted $C_1$-$C_9$ aliphatic wherein one or more methylene units are optionally and independently replaced by -Cy- or —C(O)—. In some embodiments, $R^{L2}$ is an optionally substituted $C_1$-$C_9$ aliphatic wherein one or more methylene units are optionally and independently replaced by -Cy-. In some embodiments, $R^{L2}$ is an optionally substituted $C_1$-$C_9$ aliphatic wherein one or more methylene units are optionally and independently replaced by an optionally substituted heterocycylene. In some embodiments, $R^{L2}$ is an optionally substituted $C_1$-$C_9$ aliphatic wherein one or more methylene units are optionally and independently replaced by an optionally substituted arylene.

In some embodiments, $R^{L2}$ is an optionally substituted $C_1$-$C_9$ aliphatic wherein one or more methylene units are optionally and independently replaced by an optionally substituted heteroarylene. In some embodiments, $R^{L2}$ is an optionally substituted $C_1$-$C_9$ aliphatic wherein one or more methylene units are optionally and independently replaced by an optionally substituted $C_3$-$C_{10}$ carbocyclylene. In some embodiments, $R^{L2}$ is an optionally substituted $C_1$-$C_9$ aliphatic wherein two methylene units are optionally and independently replaced by -Cy- or —C(O)—. In some embodiments, $R^{L2}$ is an optionally substituted $C_1$-$C_9$ aliphatic wherein two methylene units are optionally and independently replaced by -Cy- or —C(O)—. Exemplary $R^{L2}$ groups are depicted below:

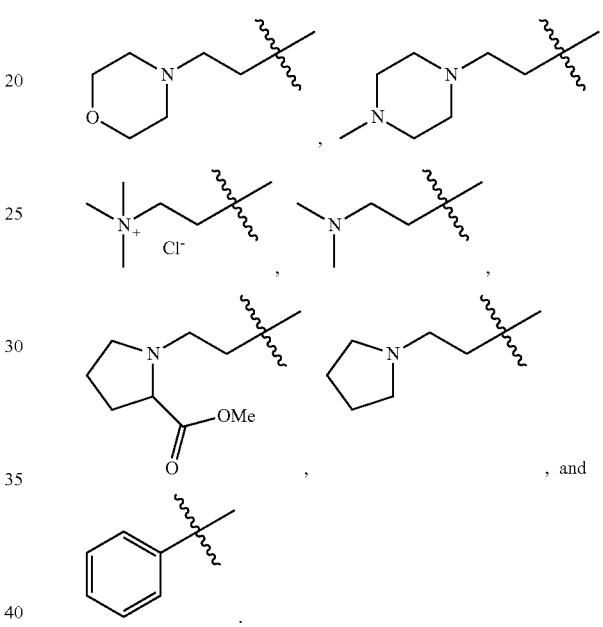

In some embodiments, $R^1$ is hydrogen, or an optionally substituted group selected from

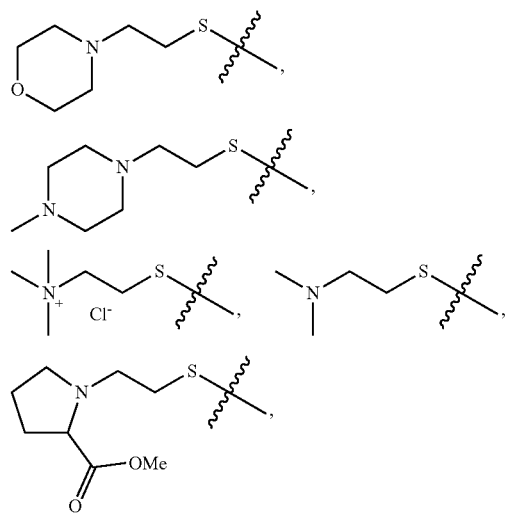

-continued

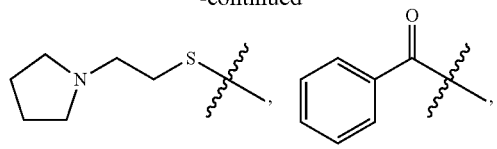

—S—(C$_1$-C$_{10}$ aliphatic), C$_1$-C$_{10}$ aliphatic, aryl, C$_1$-C$_6$ heteroalkyl, heteroaryl and heterocyclyl. In some embodiments, R$^1$ is

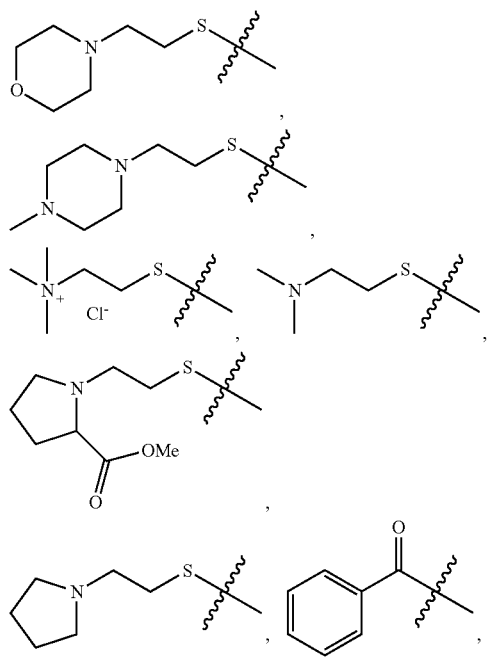

or —S—(C$_1$-C$_{10}$ aliphatic). In some embodiments, R$^1$ is

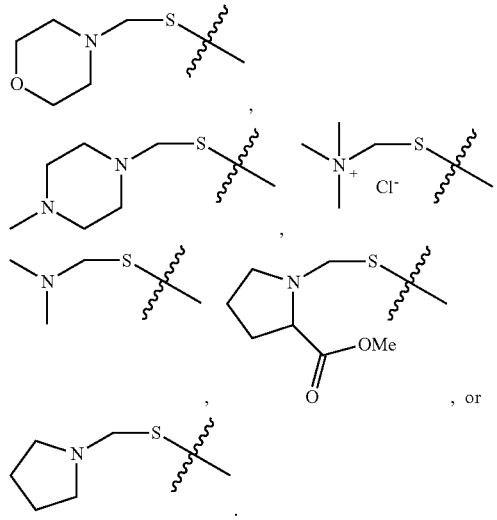

In some embodiments, R$^1$ is an optionally substituted group selected from —S—(C$_1$-C$_6$ aliphatic), C$_1$-C$_{10}$ aliphatic, C$_1$-C$_6$ heteroaliphatic, aryl, heterocyclyl and heteroaryl.

In some embodiments, R$^1$ is

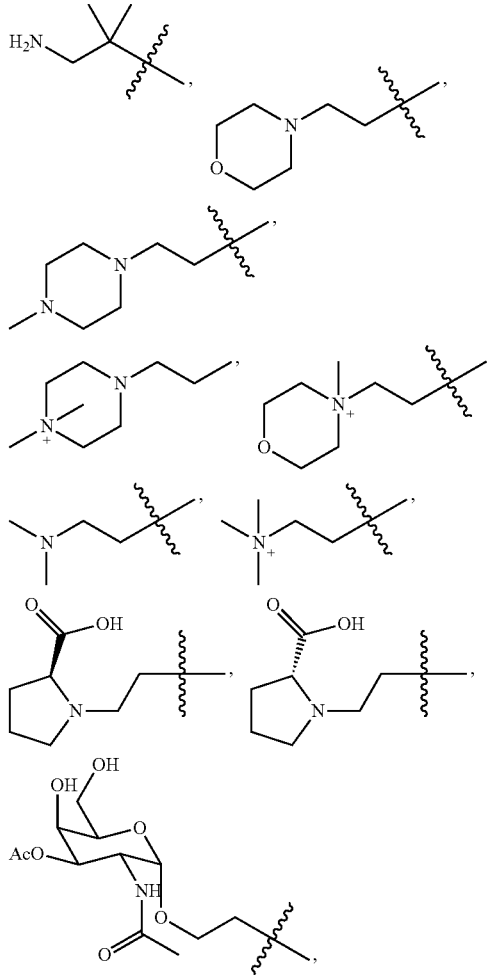

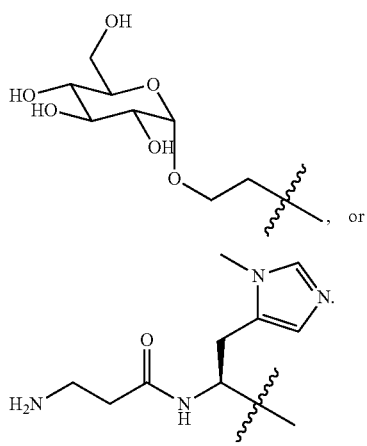

In some embodiments, the sulfur atom in the R$^1$ embodiments described above and herein is connected with the sulfur atom, G, E, or —C(O)— moiety in the L embodiments described above and herein. In some embodiments, the —C(O)— moiety in the R$^1$ embodiments described above and herein is connected with the sulfur atom, G, E, or —C(O)— moiety in the L embodiments described above and herein.

In some embodiments, -L-R$^1$ is any combination of the L embodiments and R$^1$ embodiments described above and herein.

In some embodiments, -L-R$^1$ is -L$^3$-G-R$^1$ wherein each variable is independently as defined above and described herein.

In some embodiments, -L-R$^1$ is -L$^4$-G-R$^1$ wherein each variable is independently as defined above and described herein.

In some embodiments, -L-R$^1$ is -L$^3$-G-S—R$^{L2}$, wherein each variable is independently as defined above and described herein.

In some embodiments, -L-R$^1$ is -L$^3$-G-C(O)—R$^{L2}$, wherein each variable is independently as defined above and described herein.

In some embodiments, -L-R$^1$ is

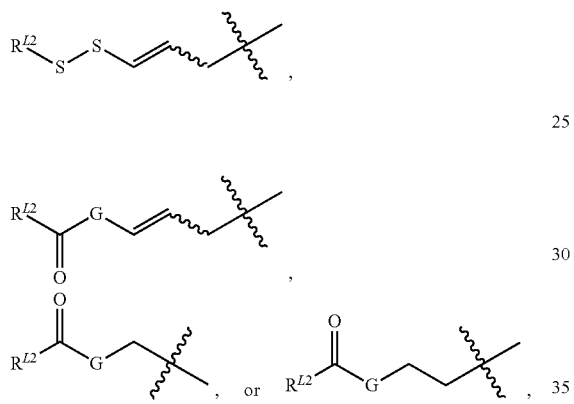

wherein R$^{L2}$ is an optionally substituted C$_1$-C$_9$ aliphatic wherein one or more methylene units are optionally and independently replaced by an optionally substituted C$_1$-C$_6$ alkylene, C$_1$-C$_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—, and each G is independently as defined above and described herein.

In some embodiments, -L-R$^1$ is —R$^{L3}$—S—S—R$^{L2}$, wherein each variable is independently as defined above and described herein. In some embodiments, -L-R$^1$ is —R$^{L3}$—C(O)—S—S—R$^{L2}$, wherein each variable is independently as defined above and described herein.

In some embodiments, -L-R$^1$ has the structure of:

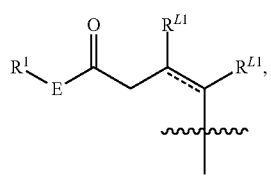

wherein each variable is independently as defined above and described herein.

In some embodiments, -L-R$^1$ has the structure of:

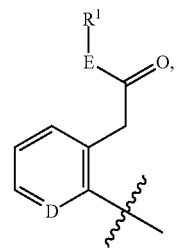

wherein each variable is independently as defined above and described herein.

In some embodiments, -L-R$^1$ has the structure of:

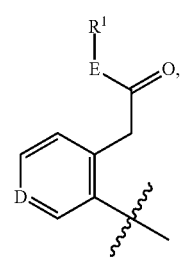

wherein each variable is independently as defined above and described herein.

In some embodiments, -L-R$^1$ has the structure of:

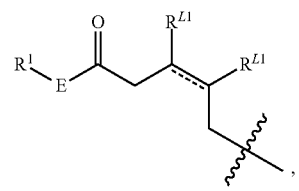

wherein each variable is independently as defined above and described herein.

In some embodiments, -L-R$^1$ has the structure of:

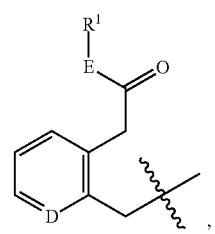

wherein each variable is independently as defined above and described herein.

In some embodiments, -L-R¹ has the structure of:

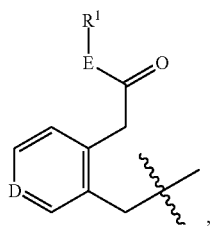

wherein each variable is independently as defined above and described herein.

In some embodiments, -L-R¹ has the structure of:

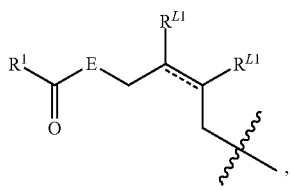

wherein each variable is independently as defined above and described herein.

In some embodiments, -L-R¹ has the structure of:

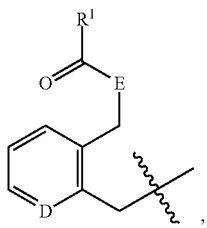

wherein each variable is independently as defined above and described herein.

In some embodiments, -L-R¹ has the structure of:

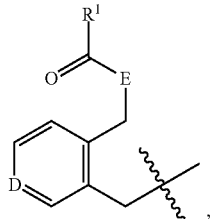

wherein each variable is independently as defined above and described herein.

In some embodiments, -L-R¹ has the structure of:

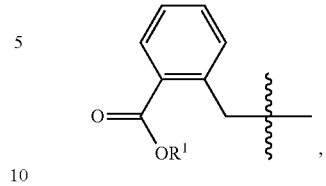

wherein each variable is independently as defined above and described herein.

In some embodiments, -L-R¹ has the structure of:

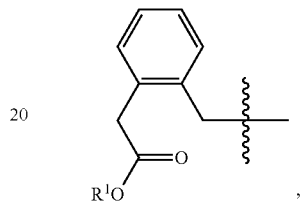

wherein each variable is independently as defined above and described herein.

In some embodiments, -L-R¹ has the structure of:

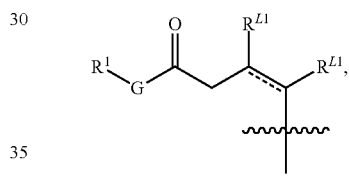

wherein each variable is independently as defined above and described herein.

In some embodiments, -L-R¹ has the structure of:

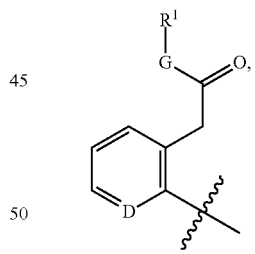

wherein each variable is independently as defined above and described herein.

In some embodiments, -L-R¹ has the structure of:

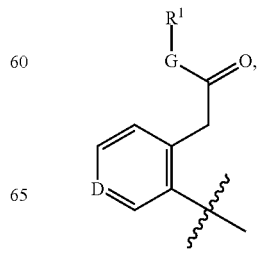

wherein each variable is independently as defined above and described herein.

In some embodiments, -L-R¹ has the structure of:

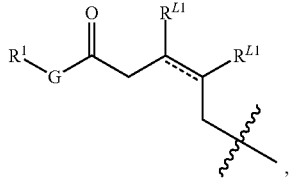

wherein each variable is independently as defined above and described herein.

In some embodiments, -L-R¹ has the structure of:

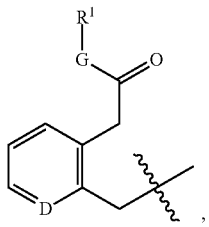

wherein each variable is independently as defined above and described herein.

In some embodiments, -L-R¹ has the structure of:

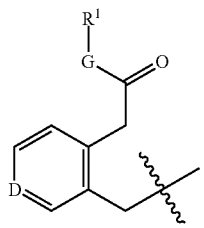

wherein each variable is independently as defined above and described herein.

In some embodiments, -L-R¹ has the structure of:

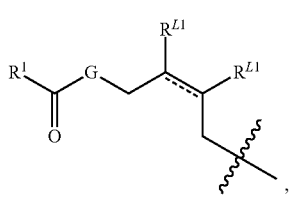

wherein each variable is independently as defined above and described herein.

In some embodiments, -L-R¹ has the structure of:

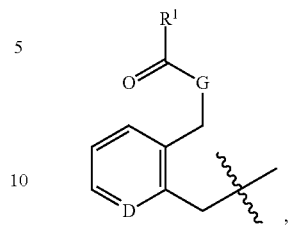

wherein each variable is independently as defined above and described herein.

In some embodiments, -L-R¹ has the structure of:

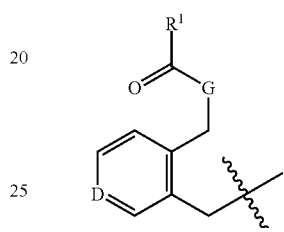

wherein each variable is independently as defined above and described herein.

In some embodiments, -L-R¹ has the structure of:

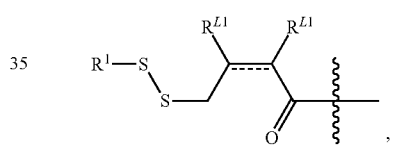

wherein each variable is independently as defined above and described herein.

In some embodiments, L has the structure of:

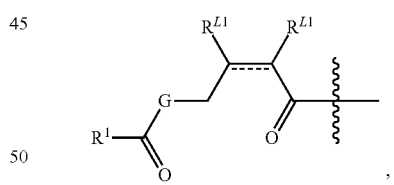

wherein each variable is independently as defined above and described herein.

In some embodiments, —X-L-R¹ has the structure of:

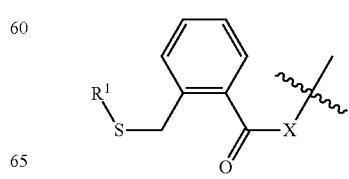

wherein:
the phenyl ring is optionally substituted, and
each of $R^1$ and X is independently as defined above and described herein.
In some embodiments, -L-$R^1$ is
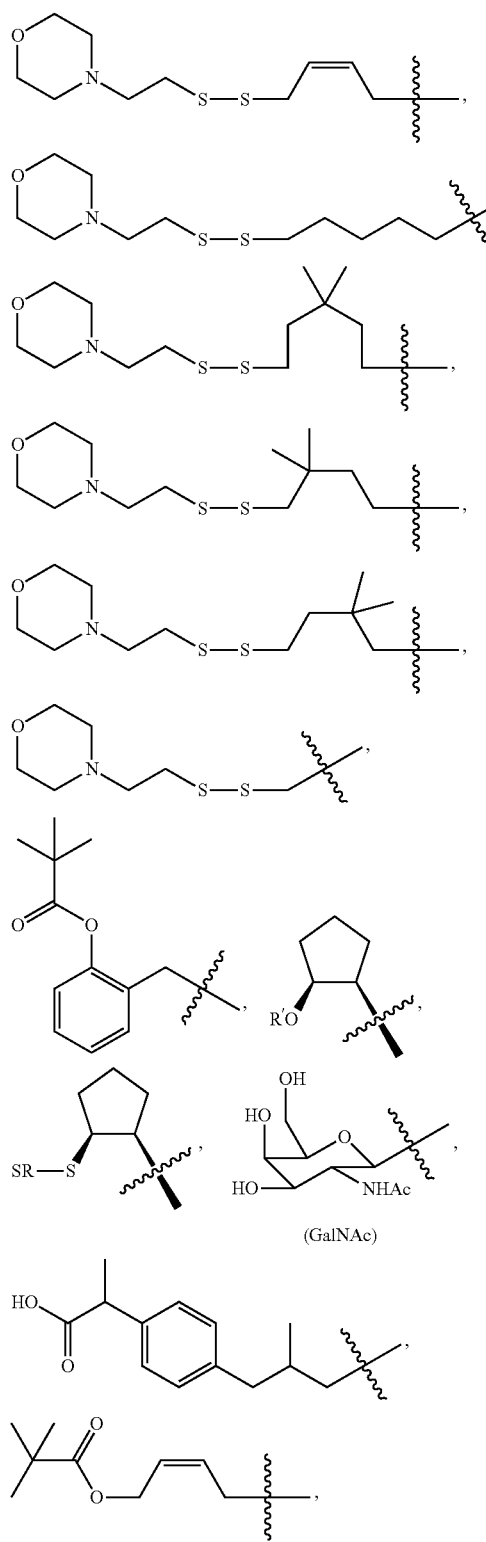
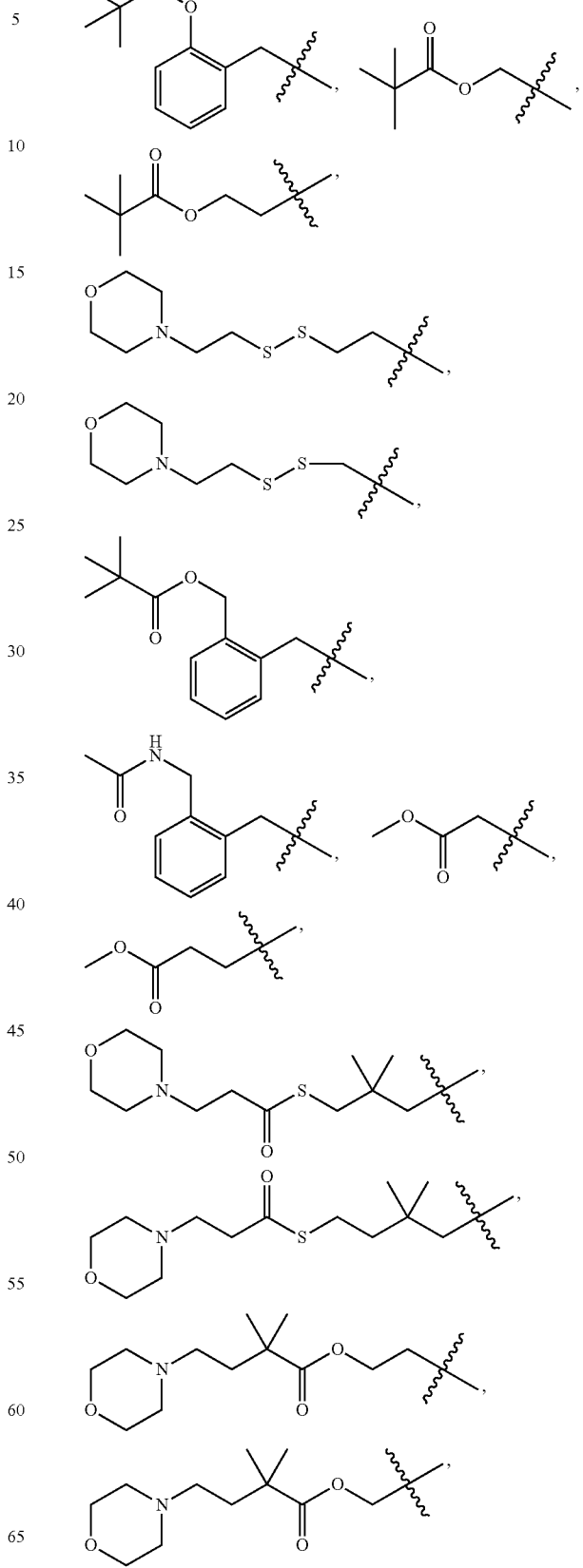

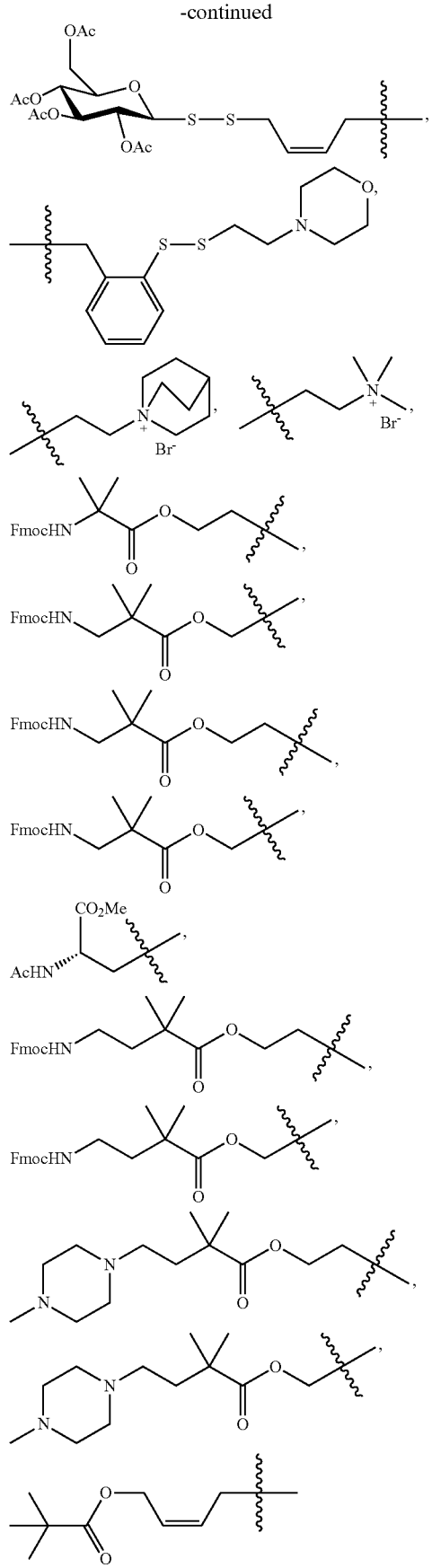
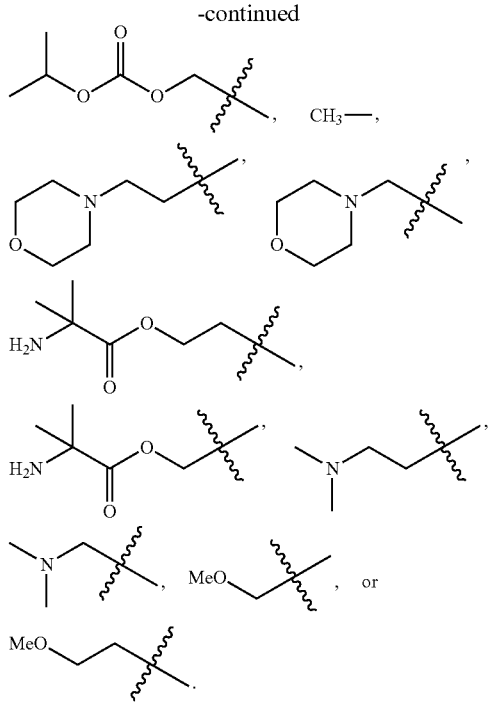
In some embodiments, -L-R¹ is:
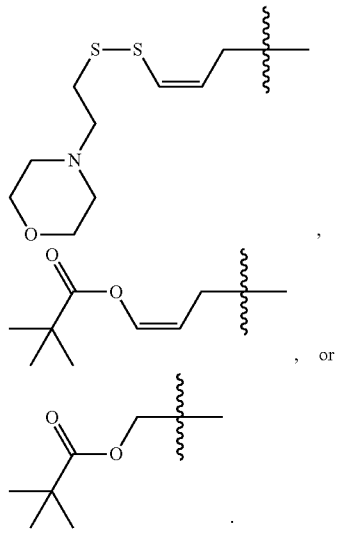
In some embodiments, -L-R¹ is CH₃—,
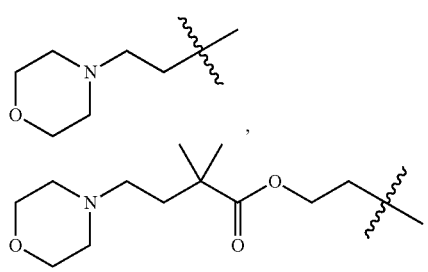

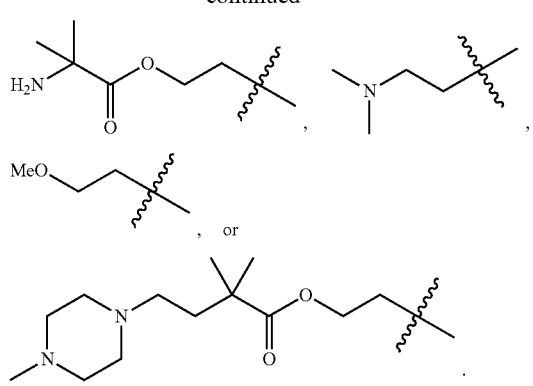

In some embodiments, -L-R¹ is

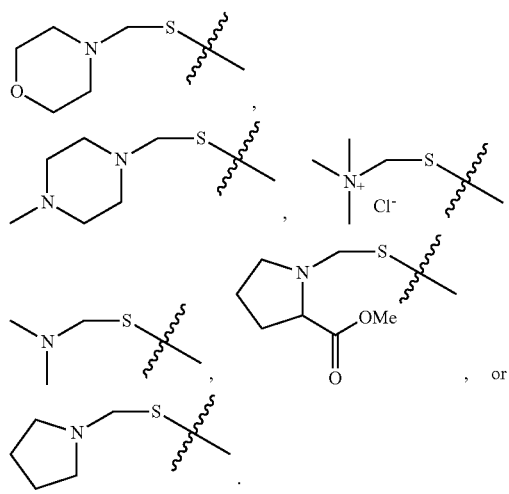

In some embodiments, -L-R¹ comprises a terminal optionally substituted —(CH$_2$)$_2$— moiety which is connected to X. In some embodiments, -L-R¹ comprises a terminal —(CH$_2$)$_2$— moiety which is connected to X. Exemplary such -L-R¹ moieties are depicted below:

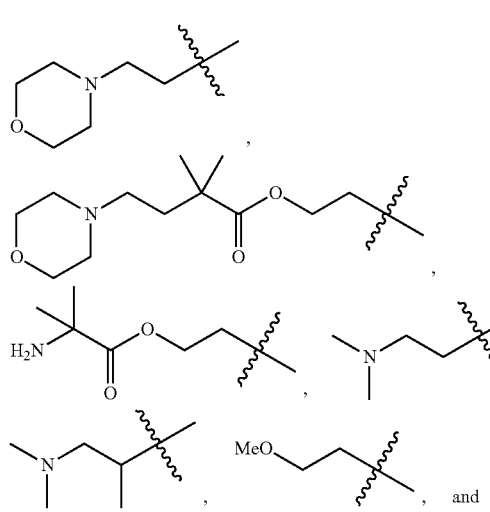

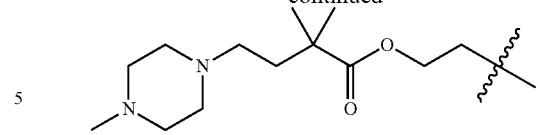

In some embodiments, -L-R¹ comprises a terminal optionally substituted —(CH$_2$)— moiety which is connected to X. In some embodiments, -L-R¹ comprises a terminal —(CH$_2$)— moiety which is connected to X. Exemplary such -L-R¹ moieties are depicted below:

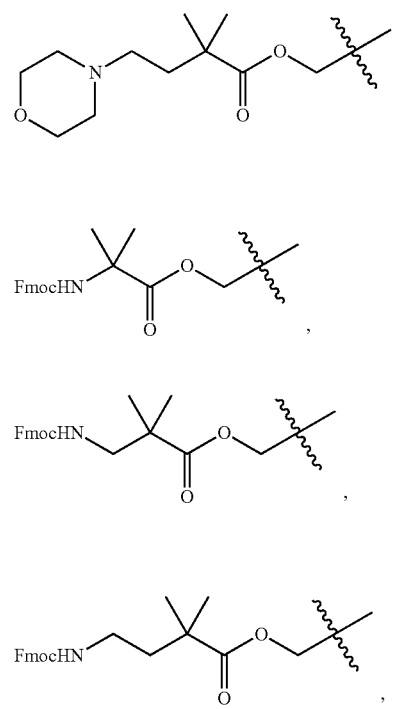

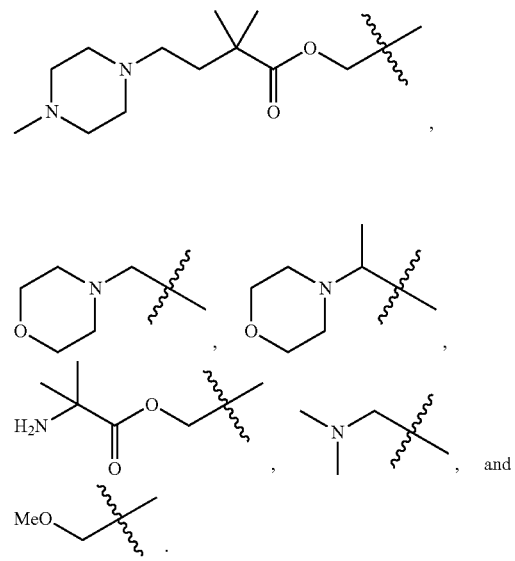

In some embodiments, -L-R¹ is
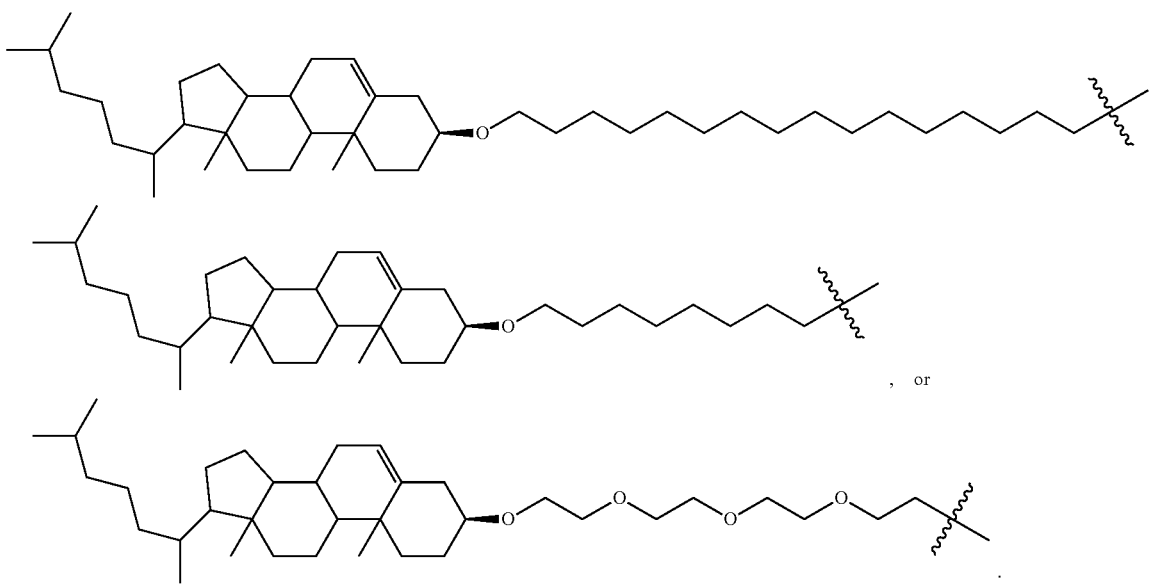
In some embodiments, -L-R¹ is CH₃—,
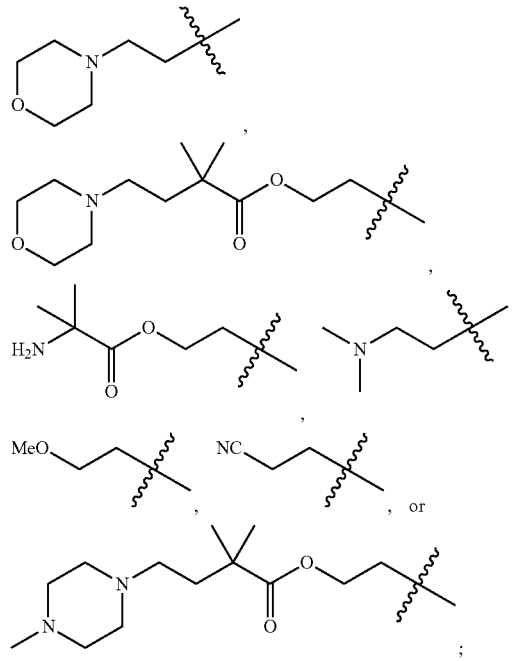
and X is —S—.
In some embodiments, -L-R¹ is CH₃—,
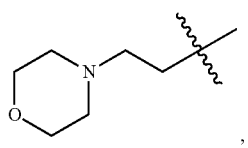
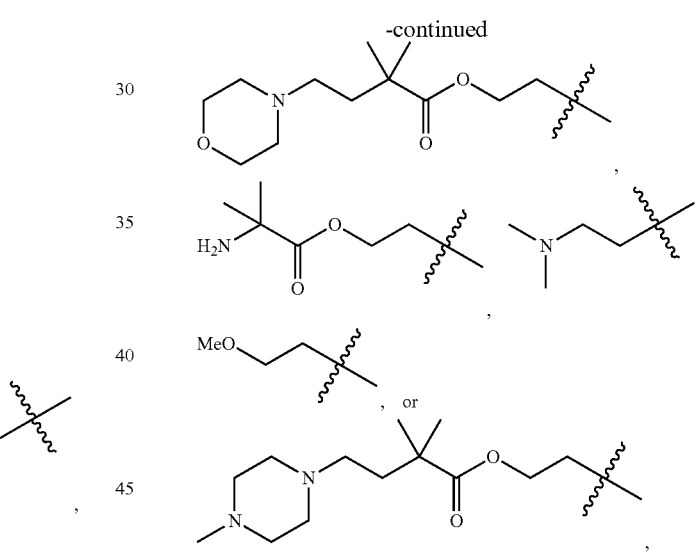
X is —S—, W is O, Y is —O—, and Z is —O—.
In some embodiments, R¹ is
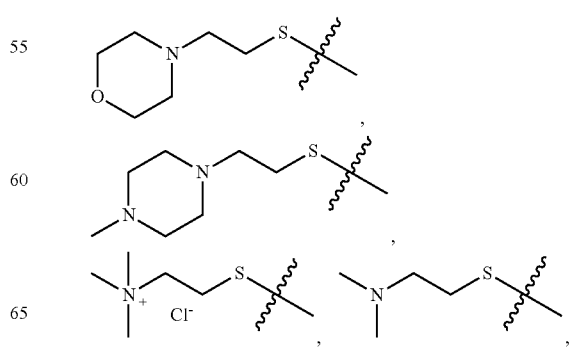

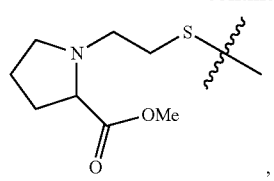
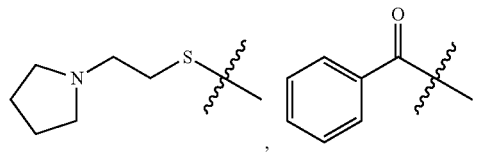
or —S—(C$_1$-C$_{10}$ aliphatic).
In some embodiments, R$^1$ is
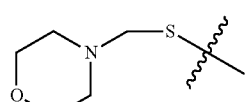
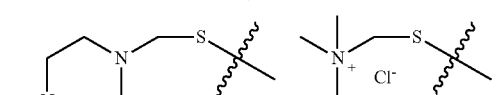
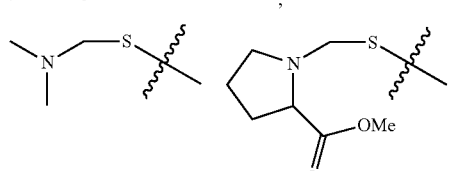, or
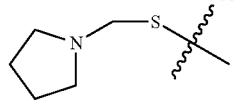
In some embodiments, X is —O— or —S—, and R$^1$ is
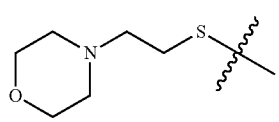
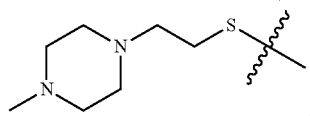
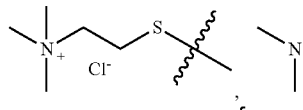
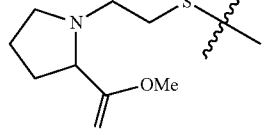
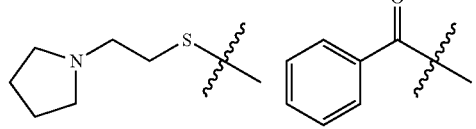
or —S—(C$_1$-C$_{10}$ aliphatic).
In some embodiments, X is —O— or —S—, and R$^1$ is
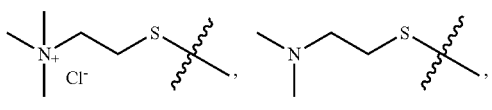
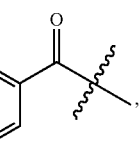
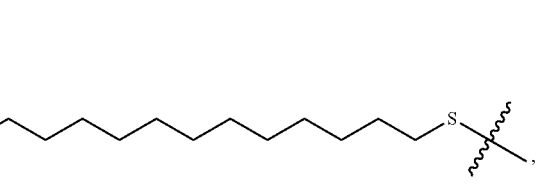

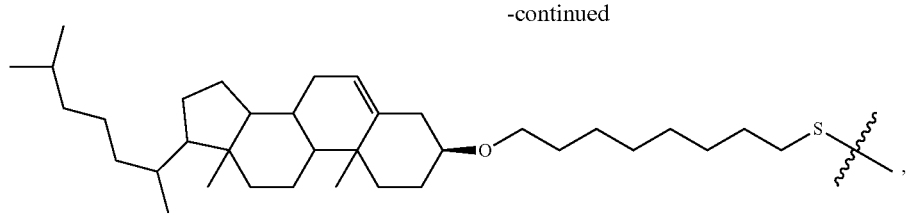
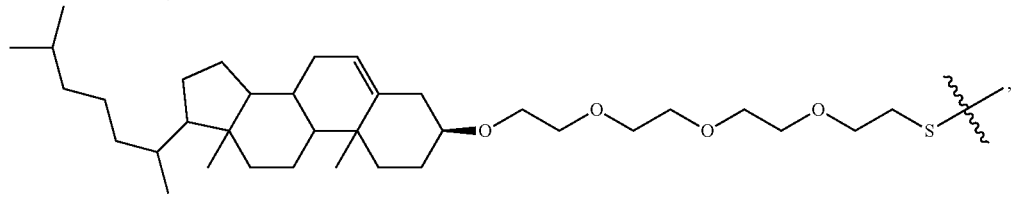
—S—(C$_1$-C$_{10}$ aliphatic) or —S—(C$_1$-C$_{50}$ aliphatic).
In some embodiments, L is a covalent bond and -L-R$^1$ is R$^1$.
In some embodiments, -L-R$^1$ is not hydrogen.
In some embodiments, —X-L-R$^1$ is R$^1$ is
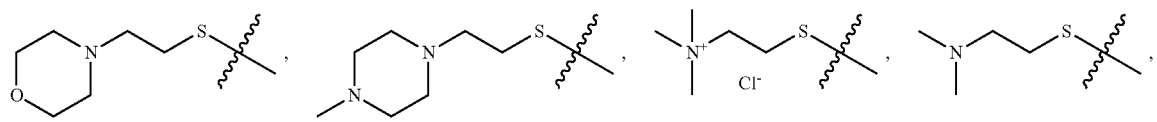
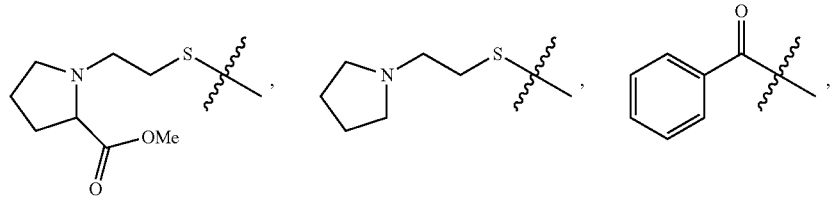
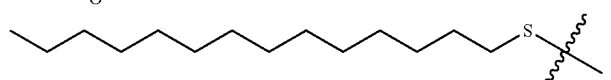
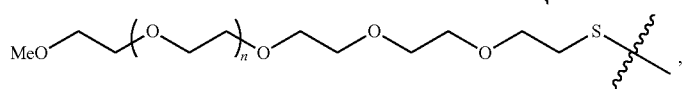
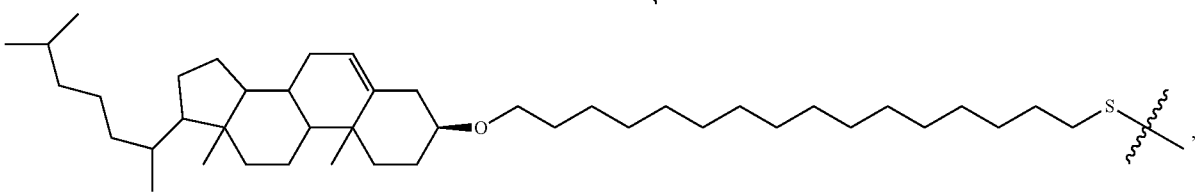
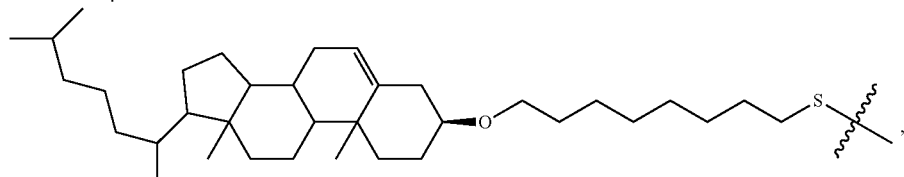
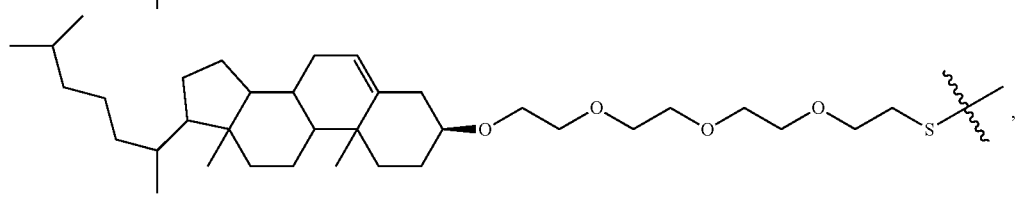
—S—(C$_1$-C$_{10}$ aliphatic) or —S—(C$_1$-C$_{50}$ aliphatic).

In some embodiments, —X-L-R¹ has the structure of

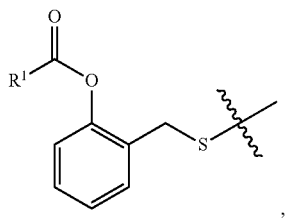

, wherein the

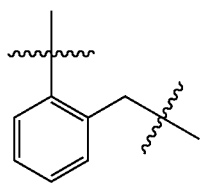 [SMILES: *Cc1ccccc1*]

moiety is optionally substituted. In some embodiments, —X-L-R¹ is

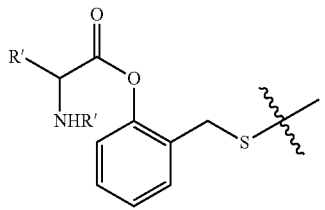

In some embodiments, —X-L-R¹ is

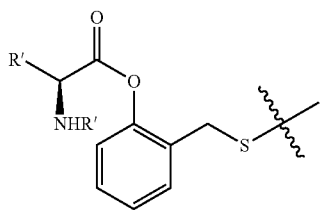

In some embodiments, —X-L-R¹ is

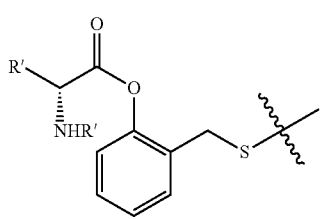

In some embodiments, —X-L-R¹ has the structure of

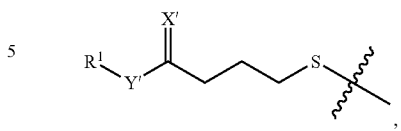

, wherein X' is O or S, Y' is —O—, —S— or —NR'—, and the

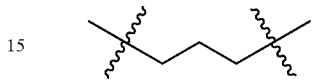

moiety is optionally substituted. In some embodiments, Y' is —O—, —S— or —NH—. In some embodiments,

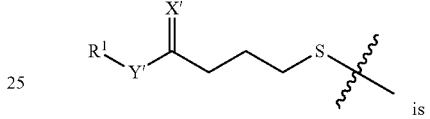

is

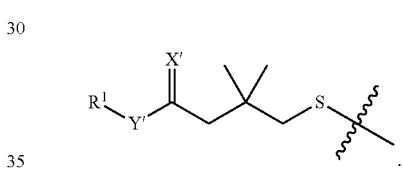

In some embodiments,

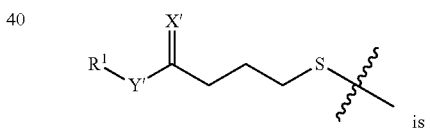

is

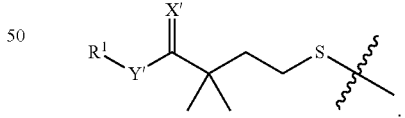

In some embodiments,

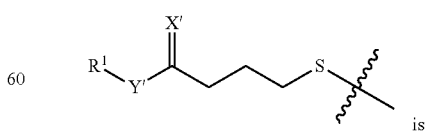

is

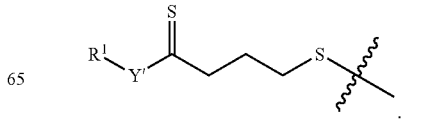

.

In some embodiments, —X-L-R¹ has the structure of

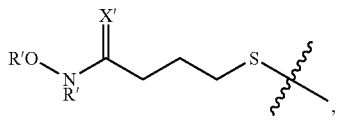

wherein X' is O or S, and the

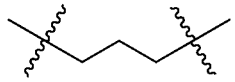 [SMILES: *CCC*]

moiety is optionally substituted. In some embodiments,

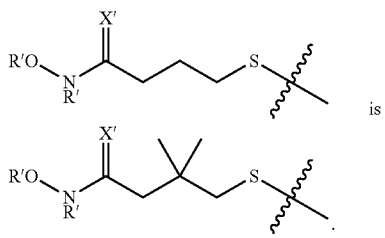 is

In some embodiments, —X-L-R¹ is

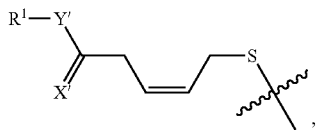

wherein the

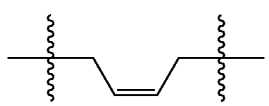 [SMILES: *C/C=C\C*]

is optionally substituted. In some embodiments, —X-L-R¹ is

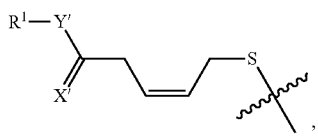

wherein the

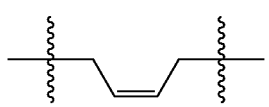

is substituted. In some embodiments, —X-L-R¹ is

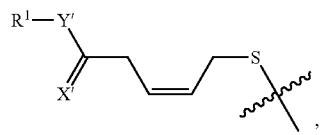

wherein the

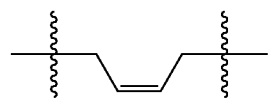

is unsubstituted.

In some embodiments, —X-L-R¹ is R¹—C(O)—S-L$^x$-S—, wherein L$^x$ is an optionally substituted group selected from

,

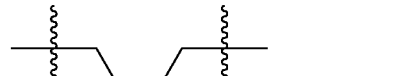,

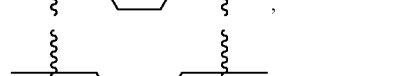,

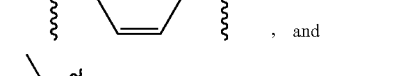, and

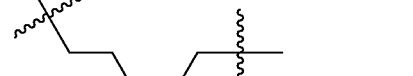.

In some embodiments, L$^x$ is

,

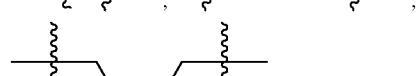,

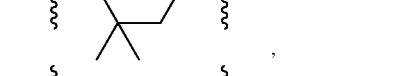,

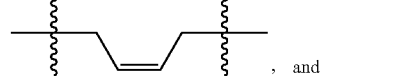, and

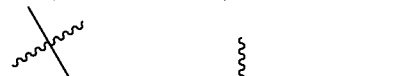.

In some embodiments, —X-L-R¹ is (CH₃)₃C—S—S-L$^x$-S—. In some embodiments, —X-L-R¹ is R'—C(=X')—Y'—C(R)₂—S-L$^x$-S—. In some embodiments, —X-L-R¹ is R—C(=X')—Y'—CH₂—S-L$^x$-S—. In some embodiments, —X-L-R¹ is

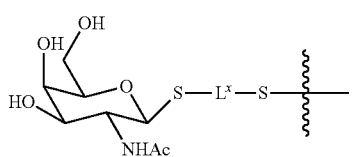

As will be appreciated by a person skilled in the art, many of the —X-L-R¹ groups described herein are cleavable and can be converted to —X⁻ after administration to a subject. In some embodiments, —X-L-R¹ is cleavable. In some embodiments, —X-L-R¹ is —S-L-R¹, and is converted to —S⁻ after administration to a subject. In some embodiments, the conversion is promoted by an enzyme of a subject. As appreciated by a person skilled in the art, methods of determining whether the —S-L-R¹ group is converted to —S⁻ after administration is widely known and practiced in the art, including those used for studying drug metabolism and pharmacokinetics.

In some embodiments, the internucleotidic linkage having the structure of formula I is

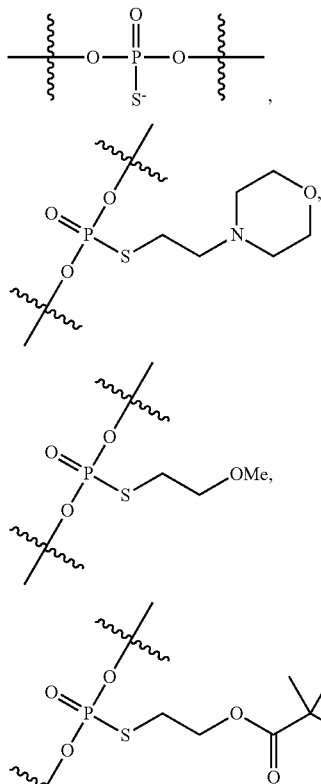

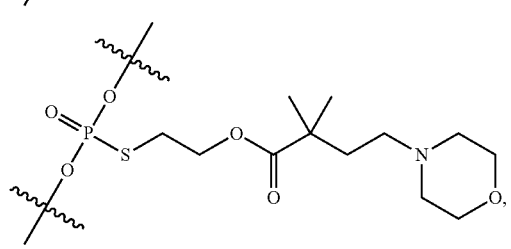

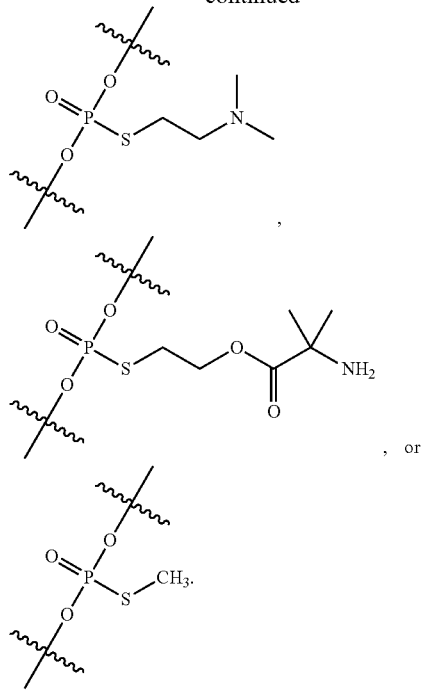

, or

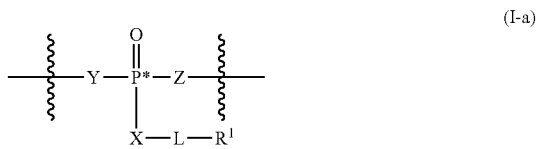

In some embodiments, the internucleotidic linkage of formula I has the structure of formula I-a:

$$\begin{array}{c}\text{(I-a)}\\\text{—Y—P*—Z—}\\|\\\text{X—L—R}^1\end{array}$$

wherein each variable is independently as defined above and described herein.

In some embodiments, the internucleotidic linkage of formula I has the structure of formula I-b:

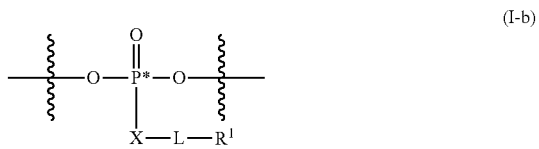

wherein each variable is independently as defined above and described herein.

In some embodiments, the internucleotidic linkage of formula I is an phosphorothioate triester linkage having the structure of formula I-c:

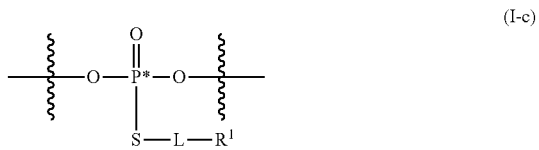

wherein:

P* is an asymmetric phosphorus atom and is either Rp or Sp;

L is a covalent bond or an optionally substituted, linear or branched $C_1$-$C_{10}$ alkylene, wherein one or more methylene units of L are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—;

$R^1$ is halogen, R, or an optionally substituted $C_1$-$C_{50}$ aliphatic wherein one or more methylene units are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—;

each R' is independently —R, —C(O)R, —CO$_2$R, or —SO$_2$R, or:
  two R' on the same nitrogen are taken together with their intervening atoms to form an optionally substituted heterocyclic or heteroaryl ring, or
  two R' on the same carbon are taken together with their intervening atoms to form an optionally substituted aryl, carbocyclic, heterocyclic, or heteroaryl ring;

-Cy- is an optionally substituted bivalent ring selected from phenylene, carbocyclylene, arylene, heteroarylene, or heterocyclylene;

each R is independently hydrogen, or an optionally substituted group selected from $C_1$-$C_6$ aliphatic, phenyl, carbocyclyl, aryl, heteroaryl, or heterocyclyl;

each

independently represents a connection to a nucleoside; and $R^1$ is not —H when L is a covalent bond.

In some embodiments, the internucleotidic linkage having the structure of formula I is

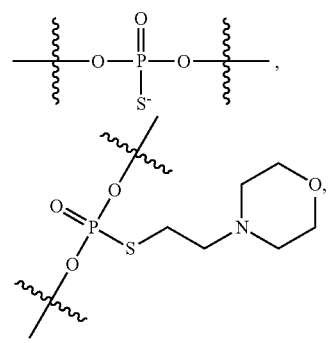

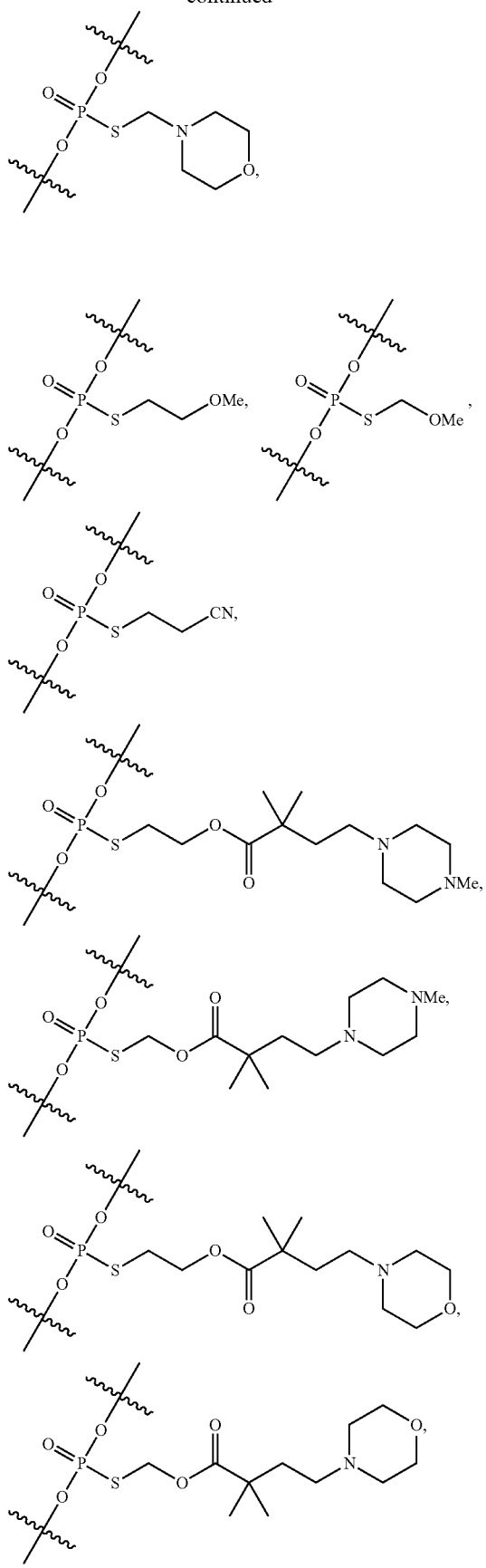

111
-continued
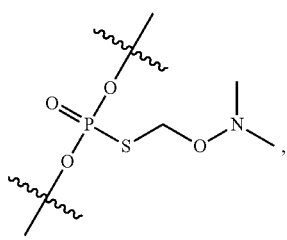
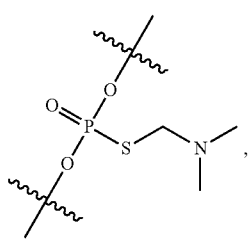
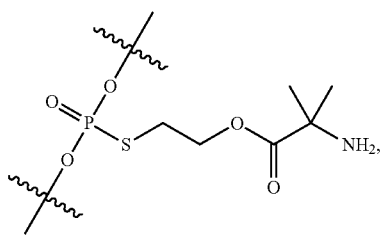
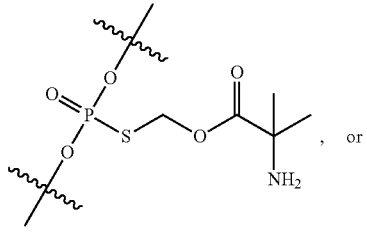
, or
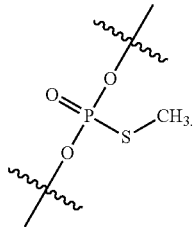
In some embodiments, the internucleotidic linkage having the structure of formula I-c is
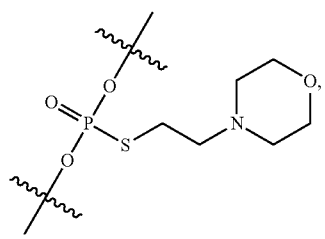
112
-continued
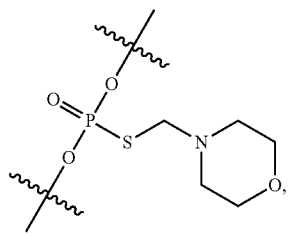
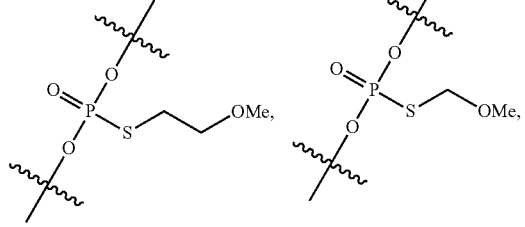
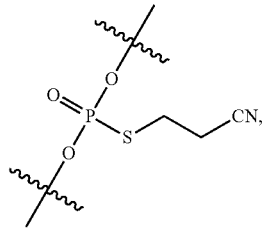
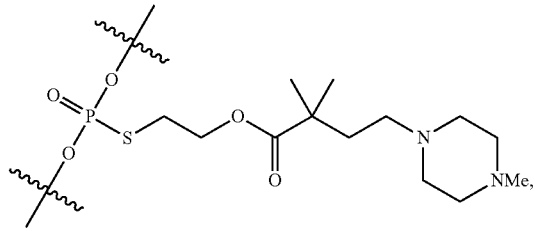
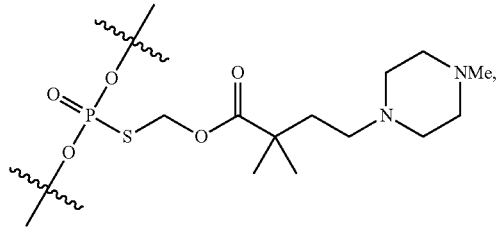
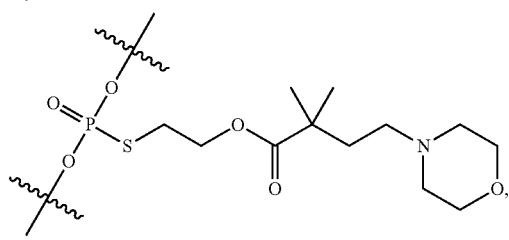
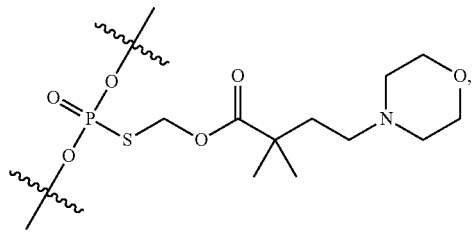

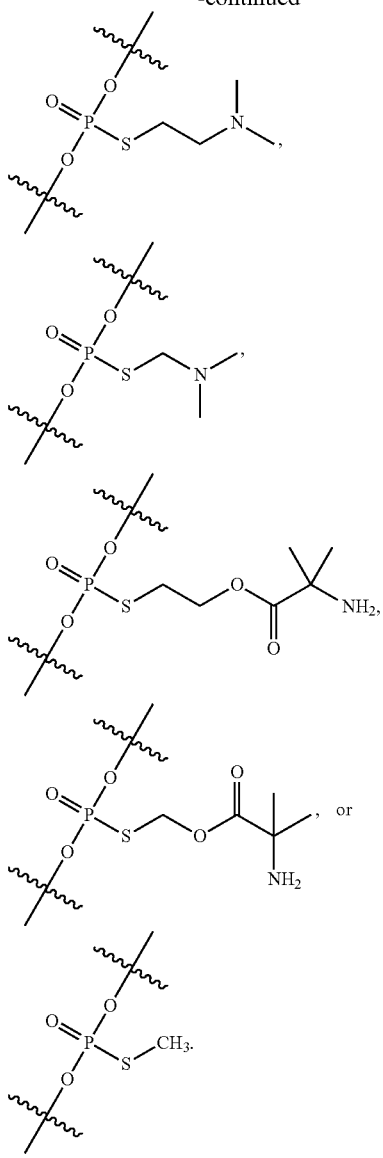

In some embodiments, the present invention provides a chirally controlled oligonucleotide comprising one or more phosphate diester linkages, and one or more modified internucleotide linkages having the formula of I-a, I-b, or I-c.

In some embodiments, the present invention provides a chirally controlled oligonucleotide comprising at least one phosphate diester internucleotidic linkage and at least one phosphorothioate triester linkage having the structure of formula I-c. In some embodiments, the present invention provides a chirally controlled oligonucleotide comprising at least one phosphate diester internucleotidic linkage and at least two phosphorothioate triester linkages having the structure of formula I-c. In some embodiments, the present invention provides a chirally controlled oligonucleotide comprising at least one phosphate diester internucleotidic linkage and at least three phosphorothioate triester linkages having the structure of formula I-c. In some embodiments, the present invention provides a chirally controlled oligonucleotide comprising at least one phosphate diester internucleotidic linkage and at least four phosphorothioate triester linkages having the structure of formula I-c. In some embodiments, the present invention provides a chirally controlled oligonucleotide comprising at least one phosphate diester internucleotidic linkage and at least five phosphorothioate triester linkages having the structure of formula I-c.

In some embodiments, the present invention provides a chirally controlled oligonucleotide comprising a sequence found in any of the Appendixes of the application. In some embodiments, the present invention provides a chirally controlled oligonucleotide comprising a sequence found in Appendix A. In some embodiments, the present invention provides a chirally controlled oligonucleotide comprising a sequence found in Appendix B. In some embodiments, the present invention provides a chirally controlled oligonucleotide comprising a sequence found in Appendix C. In some embodiments, the present invention provides a chirally controlled oligonucleotide having a sequence found in any of the Appendixes of the application. In some embodiments, the present invention provides a chirally controlled oligonucleotide having a sequence found in Appendix A. In some embodiments, the present invention provides a chirally controlled oligonucleotide having a sequence found in Appendix B. In some embodiments, the present invention provides a chirally controlled oligonucleotide having a sequence found in Appendix C.

In some embodiments, the present invention provides a chirally controlled oligonucleotide comprising a sequence found in GCCTCAGTCTGCTTCGCACC (SEQ ID NO: 106). In some embodiments, the present invention provides a chirally controlled oligonucleotide comprising a sequence found in GCCTCAGTCTGCTTCGCACC (SEQ ID NO: 106), wherein the said sequence has over 50% identity with GCCTCAGTCTGCTTCGCACC (SEQ ID NO: 106. In some embodiments, the present invention provides a chirally controlled oligonucleotide comprising a sequence found in GCCTCAGTCTGCTTCGCACC (SEQ ID NO: 106), wherein the said sequence has over 60% identity with GCCTCAGTCTGCTTCGCACC (SEQ ID NO: 106. In some embodiments, the present invention provides a chirally controlled oligonucleotide comprising a sequence found in GCCTCAGTCTGCTTCGCACC (SEQ ID NO: 106), wherein the said sequence has over 70% identity with GCCTCAGTCTGCTTCGCACC (SEQ ID NO: 106). In some embodiments, the present invention provides a chirally controlled oligonucleotide comprising a sequence found in GCCTCAGTCTGCTTCGCACC (SEQ ID NO: 106), wherein the said sequence has over 80% identity with GCCTCAGTCTGCTTCGCACC (SEQ ID NO: 106). In some embodiments, the present invention provides a chirally controlled oligonucleotide comprising a sequence found in GCCTCAGTCTGCTTCGCACC (SEQ ID NO: 106), wherein the said sequence has over 90% identity with GCCTCAGTCTGCTTCGCACC (SEQ ID NO: 106. In some embodiments, the present invention provides a chirally controlled oligonucleotide comprising a sequence found in GCCTCAGTCTGCTTCGCACC (SEQ ID NO: 106), wherein the said sequence has over 95% identity with GCCTCAGTCTGCTTCGCACC (SEQ ID NO: 106). In some embodiments, the present invention provides a chirally controlled oligonucleotide comprising the sequence of GCCTCAGTCTGCTTCGCACC (SEQ ID NO: 106). In some embodiments, the present invention provides a chirally controlled oligonucleotide having the sequence of GCCTCAGTCTGCTTCGCACC (SEQ ID NO: 106).

In some embodiments, the present invention provides a chirally controlled oligonucleotide comprising a sequence found in GCCTCAGTCTGCTTCGCACC (SEQ ID NO:

106), wherein at least one internucleotidic linkage has a chiral linkage phosphorus. In some embodiments, the present invention provides a chirally controlled oligonucleotide comprising a sequence found in GCCTCAGTCTGCTTCG-CACC (SEQ ID NO: 106), wherein at least one internucleotidic linkage has the structure of formula I. In some embodiments, the present invention provides a chirally controlled oligonucleotide comprising a sequence found in GCCTCA-GTCTGCTTCGCACC (SEQ ID NO: 106), wherein each internucleotidic linkage has the structure of formula I. In some embodiments, the present invention provides a chirally controlled oligonucleotide comprising a sequence found in GCCTCAGTCTGCTTCGCACC (SEQ ID NO: 106), wherein at least one internucleotidic linkage has the structure of formula I-c. In some embodiments, the present invention provides a chirally controlled oligonucleotide comprising a sequence found in GCCTCAGTCTGCTTCG-CACC (SEQ ID NO: 106), wherein each internucleotidic linkage has the structure of formula I-c. In some embodiments, the present invention provides a chirally controlled oligonucleotide comprising a sequence found in GCCTCA-GTCTGCTTCGCACC (SEQ ID NO: 106, wherein at least one internucleotidic linkage is

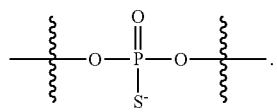

In some embodiments, the present invention provides a chirally controlled oligonucleotide comprising a sequence found in GCCTCAGTCTGCTTCGCACC (SEQ ID NO: 106), wherein each internucleotidic linkage is

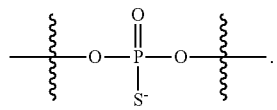

In some embodiments, the present invention provides a chirally controlled oligonucleotide comprising a sequence found in GCCTCAGTCTGCTTCGCACC (SEQ ID NO: 106), wherein at least one internucleotidic linkage is

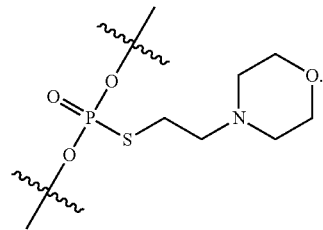

In some embodiments, the present invention provides a chirally controlled oligonucleotide comprising a sequence found in GCCTCAGTCTGCTTCGCACC (SEQ ID NO: 106, wherein each internucleotidic linkage is

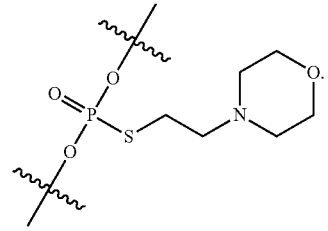

In some embodiments, the present invention provides a chirally controlled oligonucleotide comprising the sequence of GCCTCAGTCTGCTTCGCACC (SEQ ID NO: 106), wherein at least one internucleotidic linkage has a chiral linkage phosphorus. In some embodiments, the present invention provides a chirally controlled oligonucleotide comprising the sequence of GCCTCAGTCTGCTTCG-CACC (SEQ ID NO: 106), wherein at least one internucleotidic linkage has the structure of formula I. In some embodiments, the present invention provides a chirally controlled oligonucleotide comprising the sequence of GCCTCA-GTCTGCTTCGCACC (SEQ ID NO: 106), wherein each internucleotidic linkage has the structure of formula I. In some embodiments, the present invention provides a chirally controlled oligonucleotide comprising the sequence of GCCTCAGTCTGCTTCGCACC (SEQ ID NO: 106), wherein at least one internucleotidic linkage has the structure of formula I-c. In some embodiments, the present invention provides a chirally controlled oligonucleotide comprising the sequence of GCCTCAGTCTGCTTCG-CACC (SEQ ID NO: 106), wherein each internucleotidic linkage has the structure of formula I-c. In some embodiments, the present invention provides a chirally controlled oligonucleotide comprising the sequence of GCCTCA-GTCTGCTTCGCACC (SEQ. ID. NO: 106), wherein at least one internucleotidic linkage is

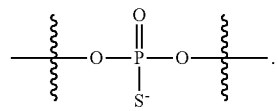

In some embodiments, the present invention provides a chirally controlled oligonucleotide comprising the sequence of GCCTCAGTCTGCTTCGCACC (SEQ ID NO: 106), wherein each internucleotidic linkage is

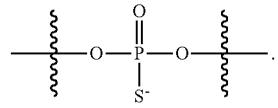

In some embodiments, the present invention provides a chirally controlled oligonucleotide comprising the sequence of GCCTCAGTCTGCTTCGCACC (SEQ ID NO: 106), wherein at least one internucleotidic linkage is

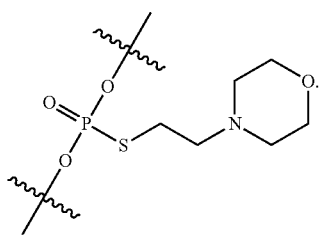

In some embodiments, the present invention provides a chirally controlled oligonucleotide comprising the sequence of GCCTCAGTCTGCTTCGCACC (SEQ ID NO: 106), wherein each internucleotidic linkage is

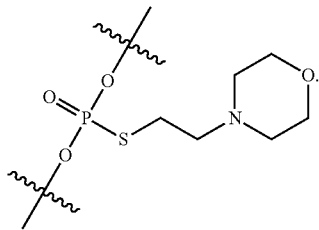

In some embodiments, the present invention provides a chirally controlled oligonucleotide having the sequence of GCCTCAGTCTGCTTCGCACC (SEQ ID NO: 106), wherein at least one internucleotidic linkage has a chiral linkage phosphorus. In some embodiments, the present invention provides a chirally controlled oligonucleotide having the sequence of GCCTCAGTCTGCTTCGCACC (SEQ ID NO: 106), wherein at least one internucleotidic linkage has the structure of formula I. In some embodiments, the present invention provides a chirally controlled oligonucleotide having the sequence of GCCTCAGTCTGCTTCG-CACC (SEQ ID NO: 106), wherein each internucleotidic linkage has the structure of formula I. In some embodiments, the present invention provides a chirally controlled oligonucleotide having the sequence of GCCTCAGTCTGCT-TCGCACC (SEQ ID NO: 106), wherein at least one internucleotidic linkage has the structure of formula I-c. In some embodiments, the present invention provides a chirally controlled oligonucleotide having the sequence of GCCTCAGTCTGCTTCGCACC (SEQ ID NO: 106), wherein each internucleotidic linkage has the structure of formula I-c. In some embodiments, the present invention provides a chirally controlled oligonucleotide having the sequence of GCCTCAGTCTGCTTCGCACC (SEQ ID NO: 106), wherein at least one internucleotidic linkage is

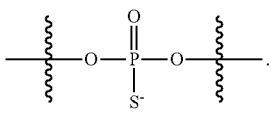

In some embodiments, the present invention provides a chirally controlled oligonucleotide having the sequence of GCCTCAGTCTGCTTCGCACC (SEQ ID NO: 106), wherein each internucleotidic linkage is

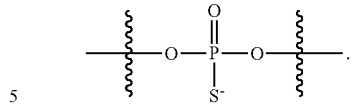

In some embodiments, the present invention provides a chirally controlled oligonucleotide having the sequence of GCCTCAGTCTGCTTCGCACC (SEQ ID NO: 106), wherein at least one internucleotidic linkage is

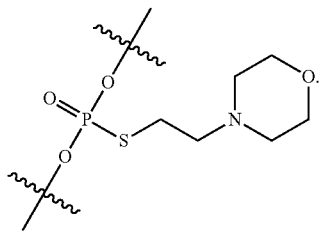

In some embodiments, the present invention provides a chirally controlled oligonucleotide having the sequence of GCCTCAGTCTGCTTCGCACC (SEQ ID NO: 106), wherein each internucleotidic linkage is

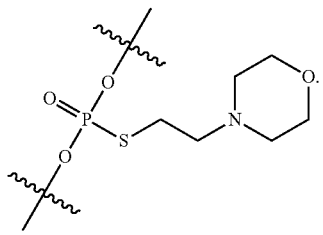

In some embodiments, the present invention provides a chirally controlled oligonucleotide having the sequence of GCCTCAGTCTGCTTCGCACC (SEQ ID NO: 106), wherein at least one linkage phosphorus is Rp. It is understood by a person of ordinary skill in the art that in certain embodiments wherein the chirally controlled oligonucleotide comprises an RNA sequence, each T is independently and optionally replaced with U. In some embodiments, the present invention provides a chirally controlled oligonucleotide having the sequence of GCCTCAGTCTGCTTCG-CACC (SEQ ID NO: 106), wherein each linkage phosphorus is Rp. In some embodiments, the present invention provides a chirally controlled oligonucleotide having the sequence of GCCTCAGTCTGCTTCGCACC (SEQ ID NO: 106), wherein at least one linkage phosphorus is Sp. In some embodiments, the present invention provides a chirally controlled oligonucleotide having the sequence of GCCTCAGTCTGCTTCGCACC (SEQ ID NO: 106), wherein each linkage phosphorus is Sp. In some embodiments, the present invention provides a chirally controlled oligonucleotide having the sequence of GCCTCAGTCT-GCTTCGCACC (SE) ID NO: 106), wherein the oligonucleotide is a blockmer. In some embodiments, the present invention provides a chirally controlled oligonucleotide having the sequence of GCCTCAGTCTGCTTCGCACC (SEQ ID NO: 106), wherein the oligonucleotide is a stereoblockmer. In some embodiments, the present invention provides a chirally controlled oligonucleotide having the sequence of GCCTCAGTCTGCTTCGCACC (SEQ ID NO: 106), wherein the oligonucleotide is a P-modification blockmer. In some embodiments, the present invention provides a chirally controlled oligonucleotide having the sequence of GCCTCAGTCTGCTTCGCACC (SEQ ID NO: 106), wherein the oligonucleotide is a linkage blockmer. In some embodiments, the present invention provides a chirally controlled oligonucleotide having the sequence of GCCTCAGTCTGCTTCGCACC (SEQ ID NO: 106), wherein the oligonucleotide is an altmer. In some embodiments, the present invention provides a chirally controlled oligonucleotide having the sequence of GCCTCAGTCTGCTTCGCACC (SEQ ID NO: 106), wherein the oligonucleotide is a stereoaltmer. In some embodiments, the present invention provides a chirally controlled oligonucleotide having the sequence of GCCTCAGTCTGCTTCGCACC (SEQ ID NO: 106), wherein the oligonucleotide is a P-modification altmer. In some embodiments, the present invention provides a chirally controlled oligonucleotide having the sequence of GCCTCAGTCTGCTTCGCACC (SEQ ID NO: 106), wherein the oligonucleotide is a linkage altmer. In some embodiments, the present invention provides a chirally controlled oligonucleotide having the sequence of GCCTCAGTCTGCTTCGCACC (SEQ ID NO: 106), wherein the oligonucleotide is a unimer. In some embodiments, the present invention provides a chirally controlled oligonucleotide having the sequence of GCCTCAGTCTGCTTCGCACC (SEQ ID NO: 106), wherein the oligonucleotide is a stereounimer. In some embodiments, the present invention provides a chirally controlled oligonucleotide having the sequence of GCCTCAGTCTGCTTCGCACC (SEQ ID NO: 106), wherein the oligonucleotide is a P-modification unimer. In some embodiments, the present invention provides a chirally controlled oligonucleotide having the sequence of GCCTCAGTCTGCTTCGCACC (SEQ ID NO: 106), wherein the oligonucleotide is a linkage unimer. In some embodiments, the present invention provides a chirally controlled oligonucleotide having the sequence of GCCTCAGTCTGCTTCGCACC (SEQ ID NO: 106), wherein the oligonucleotide is a gapmer. In some embodiments, the present invention provides a chirally controlled oligonucleotide having the sequence of GCCTCAGTCTGCTTCGCACC (SEQ ID NO: 106), wherein the oligonucleotide is a skipmer.

In some embodiments, the present invention provides a chirally controlled oligonucleotide having the sequence of GCCTCAGTCTGCTTCGCACC (SEQ ID NO: 106), wherein each cytosine is optionally and independently replaced by 5-methylcytosine. In some embodiments, the present invention provides a chirally controlled oligonucleotide having the sequence of GCCTCAGTCTGCTTCGCACC (SEQ ID NO: 106), wherein at least one cytosine is optionally and independently replaced by 5-methylcytosine. In some embodiments, the present invention provides a chirally controlled oligonucleotide having the sequence of GCCTCAGTCTGCTTCGCACC (SEQ ID NO: 106), wherein each cytosine is optionally and independently replaced by 5-methylcytosine. Exemplary chirally controlled oligonucleotides having the sequence of GCCTCAGTCTGCTTCGCACC (SEQ ID NO: 106) are depicted in Table 2, below:

TABLE 2

Exemplary chirally controlled oligonucleotides.

| Oligo | SEQ ID NO: | Stereochemistry/Sequence | Description |
|---|---|---|---|
| 101 | 106 | All-(Rp)-d[GsCsCsTsCsAsGsTsCsTsGsCsTsTsCsGsCsAsCsC] | All-R |
| 102 | 106 | All-(Sp)-d[GsCsCsTsCsAsGsTsCsTsGsCsTsTsCsGsCsAsCsC] | All-S |
| 103 | 106 | (Rp, Rp, Rp, Rp, Rp, Sp, Sp, Sp, Sp, Sp Sp, Sp, Sp, Sp, Rp, Rp, Rp, Rp, Rp)-d[GsCsCsTsCsAsGsTsCsTsGsCsTsTsCsGsCsAsCsC] | 5R-9S-5R |
| 104 | 106 | (Sp, Sp, Sp, Sp, Sp, Rp, Rp, Rp, Rp, Rp Rp, Rp, Rp, Rp, Sp, Sp, Sp, Sp, Sp)-d[GsCsCsTsCsAsGsTsCsTsGsCsTsTsCsGsCsAsCsC] | 5S-9R-5S |
| 105 | 106 | (Sp, Rp, Rp, Rp, Rp, Rp, Rp, Rp, Rp, Rp Rp, Rp, Rp, Rp, Rp, Rp, Rp, Rp, Sp)-d[GsCsCsTsCsAsGsTsCsTsGsCsTsTsCsGsCsAsCsC] | 1S-17R-1S |
| 106 | 106 | (RP, Sp, Sp, Sp, Sp, Sp, Sp, Sp, Sp, Sp Sp, Sp, Sp, Sp, Sp, Sp, Sp, Sp, Rp)-d[GsCsCsTsCsAsGsTsCsTsGsCsTsTsCsGsCsAsCsC] | 1R-17S-1R |
| 107 | 106 | (Rp, Sp, Rp, Sp, Rp, Sp, Rp, Sp, Rp, Sp Rp, Sp, Rp, Sp, Rp, Sp, Rp, Sp, Rp)-d[GsCsCsTsCsAsGsTsCsTsGsCsTsTsCsGsCsAsCsC] | (R/S)$_9$R |
| 108 | 106 | (Sp, Rp, Sp, Rp, Sp, Rp, Sp, Rp, Sp, Rp Sp, Rp, Sp, Rp, Sp, Rp, Sp, Rp, Sp)-d[GsCsCsTsCsAsGsTsCsTsGsCsTsTsCsGsCsAsCsC] | (SIR)$_9$S |
| 109 | 106 | (Sp, Sp, Sp, Rp, Rp, Rp, Rp, Rp, Rp, Rp Rp, Rp, Rp, Rp, Rp, Rp, Sp, Sp, Sp)d[GsCsCsTsCsAsGsTsCsTsGsCsTsTsCsGsCsAsCsC] | 3S-13R-3S |
| 110 | 106 | (Rp, Rp, Rp, Sp, Sp, Sp, Sp, Sp, Sp, Sp Sp, Sp, Sp, Sp, Sp, Sp, Rp, Rp, Rp)-d[GsCsCsTsCsAsGsTsCsTsGsCsTsTsCsGsCsAsCsC] | 3R-13S-3R |
| 111 | 106 | (Sp, Sp, Sp, Sp, Sp, Sp, Sp, Sp, Sp, Sp Sp, Sp, Sp, Sp, Sp, Sp, Sp, Sp, Rp)-d[GsCsCsTsCsAsGsTsCsTsGsCsTsTsCsGsCsAsCsC] | 18S/R$^{19}$ |
| 112 | 106 | (Sp, Sp, Sp, Sp, Sp, Sp, Sp, Sp, Rp, Sp Sp, Sp, Sp, Sp, Sp, Sp, Sp, Sp, Sp)-d[GsCsCsTsCsAsGsTsCsTsGsCsTsTsCsGsCsAsCsC] | 18S/R$^9$ |

TABLE 2-continued

Exemplary chirally controlled oligonucleotides.

| Oligo | SEQ ID NO: | Stereochemistry/Sequence | Description |
|---|---|---|---|
| 113 | 106 | (Sp, Rp, Sp, Sp, Sp, Sp, Sp, Sp, Sp, Sp Sp, Sp, Sp, Sp, Sp, Sp, Sp, Sp)-d[GsCsCsTsCsAsGsTsCsTsGsCsTsTsCsGsCsAsCsC] | 18S/R[2] |
| 114 | 106 | (Rp, Rp, Sp, Rp, Rp, Sp, Rp, Rp, Sp, Rp Rp, Sp, Rp, Rp, Sp, Rp, Rp, Sp, Rp)-d[GsCsCsTsCsAsGsTsCsTsGsCsTsTsCsGsCsAsCsC] | (RRS)$_6$-R |
| 115 | 106 | (Sp, Rp, Rp, Sp, Rp, Rp, Sp, Rp, Rp, Sp, Rp Rp, Sp, Rp, Rp, Sp, Rp, Rp, Sp)-d[GsCsCsTsCsAsGsTsCsTsGsCsTsTsCsGsCsAsCsC] | S-(RRS)$_6$ |
| 116 | 106 | (Rp, Sp, Rp, Rp, Sp, Rp, Rp, Sp, Rp Rp, Sp, Rp, Rp, Sp, Rp, Rp, Sp, Rp Rp)d[GsCsCsTsCsAsGsTsCsTsGsCsTsTsCsGsCsAsCsC] | RS-(RRS)$_5$-RR |
| 122 | 106 | All-(Rp)-d[Gs1Cs1Cs1Ts1Cs1As1Gs1Ts1Cs1Ts1Gs1Cs1Ts1Ts1Cs1Gs1Cs1As1Cs1C] | All-R |
| 123 | 106 | (Sp, Rp, Rp, Rp, Rp, Rp, Rp, Rp, Rp, Rp Rp, Rp, Rp, Rp, Rp, Rp, Rp, Sp)-d[Gs1Cs1Cs1Ts1Cs1As1Gs1Ts1Cs1Ts1Gs1Cs1Ts1Ts1Cs1Gs1Cs1As1Cs1C] | 1S-17R-1S |
| 124 | 106 | All-(Sp)-d[Gs1Cs1Cs1Ts1Cs1As1Gs1Ts1Cs1Ts1Gs1Cs1Ts1Ts1Cs1Gs1Cs1As1Cs1C] | All-S |
| 125 | | All-(Rp)-d[5mCs1As1Ts1G] | All-R |
| 126 | | All-(Rp)-d[Cs2As2Gs2T] | All-R |
| 127 | | All-(Rp)-d[Cs3As3Gs3T] | All-R |
| 128 | | All-(Sp)-d[Cs4As4Gs4T] | All-S |
| 129 | | All-(Sp)-d[Cs5As5Gs5T] | All-S |
| 130 | | All-(Sp)-d[Cs6As6Gs6T] | All-S |
| 131 | 106 | All-(Rp)-d[Gs7Cs7Cs7Ts7Cs7As7Gs7Ts7Cs7Ts7Gs7Cs7Ts7Ts7Cs7Gs7Cs7As7Cs7C] | All-R |
| 132 | 106 | All-(Sp)-d[Gs7Cs7Cs7Ts7Cs7As7Gs7Ts7Cs7Ts7Gs7Cs7Ts7Ts7Cs7Gs7Cs7As7Cs7C] | All-S |
| 133 | 106 | (Rp, Rp, Rp, Rp, Rp, Sp, Sp, Sp, Sp, Sp Sp, Sp, Sp, Sp, Rp, Rp, Rp, Rp, Rp)-d[Gs15mCs15mCs1Ts15mCs1As1Gs1Ts15mCs1Ts1Gs15mCs1Ts1Ts15mCs1Gs15mCs1As15mCs15mC] | 5R-9S-5R |
| 134 | 106 | (Sp, Sp, Sp, Sp, Sp, Rp, Rp, Rp, Rp, Rp Rp, Rp, Rp, Rp, Sp, Sp, Sp, Sp, Sp)-d[Gs15mCs15mCs1Ts15mCs1As1Gs1Ts15mCs1Ts1Gs15mCs1Ts1Ts15mCs1Gs15mCs1As15mCs15mC] | 5S-9R-5S |
| 135 | 108 | All-(Rp)-d[5mCs1As1Gs1Ts15mCs1Ts1Gs15mCs1Ts1Ts15mCs1G] | All-R |
| 136 | 108 | All-(Sp)-d[5mCs1As1Gs1Ts15mCs1Ts1Gs15mCs1Ts1Ts15mCs1G] | All-S |
| 137 | 108 | (Sp, Rp, Rp, Rp, Rp, Rp, Rp, Rp, Rp, Rp, Sp)-d[5mCs1As1Gs1Ts15mCs1Ts1Gs15mCs1Ts1Ts15mCs1G] | 1S-9R-1S |
| 138 | 108 | (Sp, Sp, Rp, Rp, Rp, Rp, Rp, Rp, Rp, Sp, Sp)d[5mCs1As1Gs1Ts15mCs1Ts1Gs15mCs1Ts1Ts15mCs1G] | 2S-7R-2S |
| 139 | 108 | (Rp, Sp, Sp, Sp, Sp, Sp, Sp, Sp, Sp, Sp, Rp)-d[5mCs1As1Gs1Ts15mCs1Ts1Gs15mCs1Ts1Ts15mCs1G] | 1R-9S-1R |
| 140 | 108 | (Rp, Rp, Sp, Sp, Sp, Sp, Sp, Sp, Sp, Rp, Rp)-d[5mCs1As1Gs1Ts15mCs1Ts1Gs15mCs1Ts1Ts15mCs1G] | 2R-7S-2R |
| 141 | 108 | (Sp, Sp, Sp, Rp, Rp, Rp, Rp, Rp, Sp, Sp, Sp)-d[5mCs1As1Gs1Ts15mCs1Ts1Gs15mCs1Ts1Ts15mCs1G] | 3S-5R-3S |
| 142 | 108 | (Rp, Rp, Rp, Sp, Sp, Sp, Sp, Sp, Rp, Rp, Rp)-d[5mCs1As1Gs1Ts15mCs1Ts1Gs15mCs1Ts1Ts15mCs1G] | 3R-5S-3R |
| 143 | 108 | (Sp, Sp, Rp, Sp, Sp, Rp, Sp, Sp, Rp, Sp, Sp)-d[5mCs1As1Gs1Ts15mCs1Ts1Gs15mCs1Ts1Ts15mCs1G] | (SSR)$_3$-SS |

TABLE 2-continued

Exemplary chirally controlled oligonucleotides.

| Oligo | SEQ ID NO: | Stereochemistry/Sequence | Description |
|---|---|---|---|
| 144 | 108 | (Rp, Rp, Sp, Rp, Rp, Sp, Rp, Rp, Sp, Rp, Rp)-d[5mCs1As1Gs1Ts15mCs1Ts1Gs15mCs1Ts1Ts15mCs1G] | (RRS)$_3$-RR |
| 145 | 109 | All-(Rp)-d[5mCs1Ts15mCs1As1Gs1Ts15mCs1Ts1Gs15mCs1Ts1Ts15mCs1Gs15mC] | All-R |
| 146 | | All-(Rp)-d[Gs15mCs1Ts1G] | All-R |
| 147 | | All-(Rp)-d[5mCs1As1Gs1T] | All-R |
| 148 | 108 | All-(Rp)-d[5mCs2As2Gs2Ts25mCs2Ts2Gs25mCs2Ts2Ts25mCs2G] | All-R |
| 149 | 108 | All-(Rp)-d[5mCs4As4Gs4Ts45mCs4Ts4Gs45mCs4Ts4Ts45mCs4G] | All-R |
| 150 | | All-(Rp)-d[TsCs1AsT] | All-R |
| 151 | | All-(Sp)-d[Cs1AsGs1T] | All-S |
| 152 | | All-(Sp)-d[Cs1AGs1T] | All-S |
| 153 | | All-(Sp)-d[CAs1GsT] | All-S |
| 154 | | All-(Rp)-d[Ts1Cs1As1T] | All-R |
| 155 | | All-(Rp)-d[Ts2Gs2As2C] | All-R |
| 156 | | All-(Sp)-d[Gs15mCs1Ts1G] | All-S |
| 157 | | All-(Sp)-d[5mCs1As1Gs1T] | All-S |
| 158 | 106 | (Sp, Sp, Sp, Sp, Sp, Rp, Rp, Rp, Rp, Rp Rp, Rp, Rp, Rp, Sp, Sp, Sp, Sp)-d[GsCsTsCsAsGsTsCsTsGsCsTsTsCs1GsCsACsC] | 5S-9R-4S |
| 159 | 106 | (Sp, Sp, Sp, Sp, Sp, Rp, Rp, Rp, Rp, Rp Rp, Rp, Rp, Rp, Sp, Sp, Sp, Sp, Sp)-d[Gs1Cs1Cs1Ts1CsAsGsTsCsTsGsCsTsTsCs1GsCs2As2Cs2C] | 5S-9R-5S |
| 160 | 106 | All-(Rp)-(Gs5mCs5mCsTs5mCs)$_{MOE}$d[AsGsTs5mCsTsGs5mCsTsTs5mCs](Gs5mCsAs5mCs5mC)$_{MOE}$ | All-R |
| 161 | 106 | All-(Sp)-(Gs5mCs5mCsTs5mCs)$_{MOE}$d[AsGsTs5mCsTsGs5mCsTsTs5mCs](Gs5mCsAs5mCs5mC)$_{MOE}$ | All-S |
| 162 | 106 | (Rp, Rp, Rp, Rp, Rp, Sp, Sp, Sp, Sp, Sp Sp, Sp, Sp, Sp, Rp, Rp, Rp, Rp, Rp)-(Gs5mCs5mCsTs5mCs)$_{MOE}$d[AsGsTs5mCsTsGs5mCsTsTs5mCs](Gs5mCsAs5mCs5mC)$_{MOE}$ | 5R-9S-5R |
| 163 | 106 | (Sp, Sp, Sp, Sp, Sp, Rp, Rp, Rp, Rp, Rp Rp, Rp, Rp, Rp, Sp, Sp, Sp, Sp, Sp)-(Gs5mCs5mCsTs5mCs)$_{MOE}$d[AsGsTs5mCsTsGs5mCsTsTs5mCs](Gs5mCsAs5mCs5mC)$_{MOE}$ | 5S-9R-5S |
| 164 | 106 | (Sp, Rp, Rp, Rp, Rp, Rp, Rp, Rp, Rp, Rp Rp, Rp, Rp, Rp, Rp, Rp, Rp, Sp)-(Gs5mCs5mCsTs5mCs)$_{MOE}$d[AsGsTs5mCsTsGs5mCsTsTs5mCs](Gs5mCsAs5mCs5mC)$_{MOE}$ | 1S-17R-1S |
| 165 | 106 | (Rp, Sp, Sp, Sp, Sp, Sp, Sp, Sp, Sp, Sp Sp, Sp, Sp, Sp, Sp, Sp, Sp, Rp)-(Gs5mCs5mCsTs5mCs)$_{MOE}$d[AsGsTs5mCsTsGs5mCsTsTs5mCs](Gs5mCsAs5mCs5mC)$_{MOE}$ | 1R-17S-1R |
| 166 | 106 | (Rp, Sp, Rp, Sp, Rp, Sp, Rp, Sp, Rp, Sp Rp, Sp, Rp, Sp, Rp, Sp, Rp, Sp, Rp)-(Gs5mCs5mCsTs5mCs)$_{MOE}$d[AsGsTs5mCsTsGs5mCsTsTs5mCs](Gs5mCsAs5mCs5mC)$_{MOE}$ | (R/S)$_9$R |
| 167 | 106 | (Sp, Rp, Sp, Rp, Sp, Rp, Sp, Rp, Sp, Rp Sp, Rp, Sp, Rp, Sp, Rp, Sp, Rp, Sp)-(Gs5mCs5mCsTs5mCs)$_{MOE}$d[AsGsTs5mCsTsGs5mCsTsTs5mCs](Gs5mCsAs5mCs5mC)$_{MOE}$ | (S/R)$_9$S |
| 168 | 106 | (Sp, Sp, Sp, Rp, Rp, Rp, Rp, Rp, Rp, Rp Rp, Rp, Rp, Rp, Rp, Rp, Sp, Sp, Sp)(Gs5mCs5mCsTs5mCs)$_{MOE}$d[AsGsTs5mCsTsGs5mCsTsTs5mCs](Gs5mCsAs5mCs5mC)$_{MOE}$ | 3S-13R-3S |

TABLE 2-continued

Exemplary chirally controlled oligonucleotides.

| Oligo | SEQ ID NO: | Stereochemistry/Sequence | Description |
|---|---|---|---|
| 169 | 106 | (Rp, Rp, Rp, Sp, Sp, Sp, Sp, Sp, Sp, Sp Sp, Sp, Sp, Sp, Sp, Sp, Rp, Rp, Rp)-(Gs5mCs5mCsTs5mCs)$_{MOE}$d[AsGsTs5mCsTsGs5mCsTsTs5mCs](Gs5mCsAs5mCs5mC)$_{MOE}$ | 3R-13S-3R |
| 170 | 106 | (Sp, Sp, Sp, Sp, Sp, Sp, Sp, Sp, Sp Sp, Sp, Sp, Sp, Sp, Sp, Sp, Sp, Sp, Rp)-(Gs5mCs5mCsTs5mCs)$_{MOE}$d[AsGsTs5mCsTsGs5mCsTsTs5mCs](Gs5mCsAs5mCs5mC)$_{MOE}$ | 18S/R[19] |
| 171 | 106 | (Sp, Sp, Sp, Sp, Sp, Sp, Sp, Sp, Rp Sp, Sp, Sp, Sp, Sp, Sp, Sp, Sp, Sp, Sp)-(Gs5mCs5mCsTs5mCs)$_{MOE}$d[AsGsTs5mCsTsGs5mCsTsTs5mCs](Gs5mCsAs5mCs5mC)$_{MOE}$ | 18S/R[9] |
| 172 | 106 | (Sp, Rp, Sp, Sp, Sp, Sp, Sp, Sp, Sp Sp, Sp, Sp, Sp, Sp, Sp, Sp, Sp, Sp, Sp)-(Gs5mCs5mCsTs5mCs)$_{MOE}$d[AsGsTs5mCsTsGs5mCsTsTs5mCs](Gs5mCsAs5mCs5mC)$_{MOE}$ | 18S/R[2] |
| 173 | 106 | (Rp, Rp, Sp, Rp, Rp, Sp, Rp, Rp, Sp, Rp Rp, Sp, Rp, Rp, Sp, Rp, Rp, Sp, Rp)-(Gs5mCs5mCsTs5mCs)$_{MOE}$d[AsGsTs5mCsTsGs5mCsTsTs5mCs](Gs5mCsAs5mCs5mC)$_{MOE}$ | (RRS)$_6$-R |
| 174 | 106 | (Sp, Rp, Rp, Sp, Rp, Rp, Sp, Rp, Rp, Sp, Rp Rp, Sp, Rp, Rp, Sp, Rp, Rp, Sp)-(Gs5mCs5mCsTs5mCs)$_{MOE}$d[AsGsTs5mCsTsGs5mCsTsTs5mCs](Gs5mCsAs5mCs5mC)$_{MOE}$ | S-(RRS)$_6$ |
| 175 | 106 | (Rp, Sp, Rp, Rp, Sp, Rp, Rp, Sp, Rp Rp, Sp, Rp, Rp, Sp, Rp, Rp, Sp, Rp Rp) (Gs5mCs5mCsTs5mCs)$_{MOE}$d[AsGsTs5mCsTsGs5mCsTsTs5mCs](Gs5mCsAs5mCs5mC)$_{MOE}$ | RS-(RRS)$_5$-RR |
| 176 | 106 | (Rp, Sp, Rp, Rp, Sp, Rp, Rp, Sp, Rp Rp, Sp, Rp, Rp, Sp, Rp, Rp, Sp, Rp Rp) (Gs15mCs15mCs1Ts15mCs1)$_{MOE}$d[As1Gs1Ts15mCs1Ts1Gs15mCs1Ts1Ts15mCs1] (Gs15mCs1As15mCs15mC)$_{MOE}$ | RS-(RRS)$_5$-RR |
| 177 | 106 | (Rp, Sp, Rp, Rp, Sp, Rp, Rp, Sp, Rp Rp, Sp, Rp, Rp, Sp, Rp, Rp, Sp, Rp Rp) (Gs15mCs15mCs1Ts15mCs1)$_{MOE}$d[AGT5mCTG5mCTT5mC](Gs25mCs2As25mCs25mC)$_{MOE}$ | RS-(RRS)$_5$-RR |
| 178 | 106 | (Sp, Rp, Rp, Sp, Rp, Rp, Sp, Rp, Rp, Sp, Rp Rp, Sp, Rp, Rp, Sp, Rp, Rp, Sp)-(Gs5mCs5mCsTs5mCs)$_{MOE}$d[AsGsTs5mCsTsGs5mCsTsTs5mCs](Gs5mCsAs5mCs5mC)$_F$ (F: 2-fluorodeoxyribose) | S-(RRS)$_6$ |
| 179 | 106 | (Rp, Sp, Rp, Rp, Sp, Rp, Rp, Sp, Rp Rp, Sp, Rp, Rp, Sp, Rp, Rp, Sp, Rp Rp) d[Gs8Cs8Cs8Ts8Cs8As8Gs8Ts8Cs8Ts8Gs8Cs8Ts8Ts8Cs8Gs8Cs8As8Cs8C] | RS-(RRS)$_5$-RR |
| 180 | 106 | (Rp, Sp, Rp, Rp, Sp, Rp, Rp, Sp, Rp Rp, Sp, Rp, Rp, Sp, Rp, Rp, Sp, Rp Rp) d[Gs9Cs9Cs9Ts9Cs9As9Gs9Ts9Cs9Ts9Gs9Cs9Ts9Ts9Cs9Gs9Cs9As9Cs9C] | RS-(RRS)$_5$-RR |
| 181 | 106 | (Rp, Sp, Rp, Rp, Sp, Rp, Rp, Sp, Rp Rp, Sp, Rp, Rp, Sp, Rp, Rp, Sp, Rp Rp) d[Gs10Cs10Cs10Ts10Cs10As10Gs10Ts10Cs10Ts10Gs10Cs10Ts10Ts10Cs10Gs10Cs10As10Cs10C] | RS-(RRS)$_5$-RR |
| 182 | 106 | (Rp, Sp, Rp, Rp, Sp, Rp, Rp, Sp, Rp Rp, Sp, Rp, Rp, Sp, Rp, Rp, Sp, Rp Rp) d[Gs11Cs11Cs11Ts11Cs11As11Gs11Ts11Cs11Ts11Gs11Cs11Ts11Ts11Cs11Gs11Cs11As11Cs11C] | RS-(RRS)$_5$-RR |
| 183 | 106 | (Rp, Sp, Rp, Rp, Sp, Rp, Rp, Sp, Rp Rp, Sp, Rp, Rp, Sp, Rp, Rp, Sp, Rp Rp) d[Gs12Cs12Cs12Ts12Cs12As12Gs12Ts12Cs12Ts12Gs12Cs12Ts12Ts12Cs12Gs12Cs12As12Cs12C] | RS-(RRS)$_5$-RR |
| 184 | 106 | (Rp, Sp, Rp, Rp, Sp, Rp, Rp, Sp, Rp Rp, Sp, Rp, Rp, Sp, Rp, Rp, Sp, Rp Rp) d[Gs13Cs13Cs13Ts13Cs13As13Gs13Ts13Cs13Ts13Gs13Cs13Ts13Ts13Cs13Gs13Cs13As13Cs13C] | RS-(RRS)$_5$-RR |
| 185 | 106 | (Rp, Sp, Rp, Rp, Sp, Rp, Rp, Sp, Rp Rp, Sp, Rp, Rp, Sp, Rp, Rp, Sp, Rp Rp) d[Gs14Cs14Cs14Ts14Cs14As14Gs14Ts14Cs14Ts14Gs14Cs14Ts14Ts14Cs14Gs14Cs14As14Cs14C] | RS-(RRS)$_5$-RR |
| 186 | 106 | (Rp, Sp, Rp, Rp, Sp, Rp, Rp, Sp, Rp Rp, Sp, Rp, Rp, Sp, Rp, Rp, Sp, Rp Rp) d[Gs15Cs15Cs15Ts15Cs15As15Gs15Ts15Cs15Ts15Gs15Cs15Ts15Ts15Cs15Gs15Cs15As15Cs15C] | RS-(RRS)$_5$-RR |
| 187 | 110 | (Rp, Sp, Rp, Rp, Sp, Rp, Rp, Sp, Rp Rp, Sp, Rp, Rp, Sp, Rp, Rp, Sp, Rp Rp) d[GsCsCs1TsCsAs]GsUs2CsUsGsd[CsTs3TsCsGs]CsAs4CsC | RS-(RRS)$_5$-RR |

TABLE 2-continued

Exemplary chirally controlled oligonucleotides.

| Oligo | SEQ ID NO: | Stereochemistry/Sequence | Description |
|---|---|---|---|
| 188 | 106 | (Sp, Sp, Sp, Sp, Sp, Rp, Rp, Rp, Rp, Rp Rp, Rp, Rp, Rp, Sp, Sp, Sp, Sp)-d[GsCsTsCsAsGsTsCsTsGsCsTsTsCsGsCsACsC] | 5S-9R-4S |
| 189 | 106 | (Sp, Sp, Sp, Sp, Sp, Rp, Rp, Rp, Rp, Rp Rp, Rp, Rp, Rp, Sp, Sp, Sp, Sp)-d[Gs1Cs1Cs1Ts1Cs1As1Gs1Ts1Cs1Ts1Gs1Cs1Ts1Ts1Cs1Gs1CsACs1C] | 5S-9R-4S |
| 190 | 106 | (Sp, Sp, Sp, Sp, Sp, Rp, Rp, Rp, Rp, Rp Rp, Rp, Rp, Rp, Sp, Sp, Sp, Sp)-d[Gs8Cs8Cs8Ts8Cs8As8Gs8Ts8Cs8Ts8Gs8Cs8Ts8Ts8Cs8Gs8Cs1ACs8C] | 5S-9R-4S |
| 191 | 106 | (Sp, Sp, Sp, Sp, Sp, Rp, Rp, Rp, Rp, Rp Rp, Rp, Rp, Rp, Sp, Sp, Sp, Sp)-d[Gs9Cs9Cs9Ts9Cs9As9Gs9Ts9Cs9Ts9Gs9Cs9Ts9Ts9Cs9Gs9Cs1ACs9C] | 5S-9R-4S |
| 192 | 106 | (Sp, Sp, Sp, Sp, Sp, Rp, Rp, Rp, Rp, Rp Rp, Rp, Rp, Rp, Sp, Sp, Sp, Sp)-d[Gs10Cs10Cs10Ts10Cs10As10Gs10Ts10Cs10Ts10Gs10Cs10Ts10Ts10Cs10Gs10Cs1ACs10C] | 5S-9R-4S |
| 193 | 106 | (Sp, Sp, Sp, Sp, Sp, Rp, Rp, Rp, Rp, Rp Rp, Rp, Rp, Rp, Sp, Sp, Sp, Sp)-d[Gs11Cs11Cs11Ts11Cs11As11Gs11Ts11Cs11Ts11Gs11Cs11Ts11Ts11Cs11Gs11Cs1ACs11C] | 5S-9R-4S |
| 194 | 106 | (Sp, Sp, Sp, Sp, Sp, Rp, Rp, Rp, Rp, Rp Rp, Rp, Rp, Rp, Sp, Sp, Sp, Sp)-d[Gs12Cs12Cs12Ts12Cs12As12Gs12Ts12Cs12Ts12Gs12Cs12Ts12Ts12Cs12Gs12Cs1ACs12C] | 5S-9R-4S |
| 195 | 106 | (Sp, Sp, Sp, Sp, Sp, Rp, Rp, Rp, Rp, Rp Rp, Rp, Rp, Rp, Sp, Sp, Sp, Sp)-d[Gs13Cs13Cs13Ts13Cs13As13Gs13Ts13Cs13Ts13Gs13Cs13Ts13Ts13Cs13Gs13Cs1ACs13C] | 5S-9R-4S |
| 196 | 106 | (Sp, Sp, Sp, Sp, Sp, Rp, Rp, Rp, Rp, Rp Rp, Rp, Rp, Rp, Sp, Sp, Sp, Sp)-d[Gs14Cs14Cs14Ts14Cs14As14Gs14Ts14Cs14Ts14Gs14Cs14Ts14Ts14Cs14Gs14Cs1ACs14C] | 5S-9R-4S |
| 197 | 106 | (Sp, Sp, Sp, Sp, Sp, Rp, Rp, Rp, Rp, Rp Rp, Rp, Rp, Rp, Sp, Sp, Sp, Sp)-d[Gs15Cs15Cs15Ts15Cs15As15Gs15Ts15Cs15Ts15Gs15Cs15Ts15Ts15Cs15Gs15Cs1ACs15C] | 5S-9R-4S |
| 198 | 111 | (Sp, Sp, Sp, Sp, Sp, Rp, Rp, Rp, Rp, Rp Rp, Rp, Rp, Rp, Sp, Sp, Sp, Sp)-GsCsCsUsCsAsGsUsCsUsGsCsUsUsCsGsCsACsC | 5S-9R-4S |
| 199 | 111 | (Sp, Sp, Sp, Sp, Sp, Rp, Rp, Rp, Rp, Rp Rp, Rp, Rp, Rp, Sp, Sp, Sp, Sp)-Gs1Cs1Cs1Us1Cs1As1Gs1Us1Cs1Us1Gs1Cs1Us1Us1Cs1Gs1CsACs1C | 5S-9R-4S |
| 200 | 111 | (Sp, Sp, Sp, Sp, Sp, Rp, Rp, Rp, Rp, Rp Rp, Rp, Rp, Rp, Sp, Sp, Sp, Sp)-Gs8Cs8Cs8Us8Cs8As8Gs8Us8Cs8Us8Gs8Cs8Us8Us8Cs8Gs8Cs1ACs8C | 5S-9R-4S |
| 201 | 111 | (Sp, Sp, Sp, Sp, Sp, Rp, Rp, Rp, Rp, Rp Rp, Rp, Rp, Rp, Sp, Sp, Sp, Sp)-Gs9Cs9Cs9Us9Cs9As9Gs9Us9Cs9Us9Gs9Cs9Us9Us9Cs9Gs9Cs1ACs9C | 5S-9R-4S |
| 202 | 111 | (Sp, Sp, Sp, Sp, Sp, Rp, Rp, Rp, Rp, Rp Rp, Rp, Rp, Rp, Sp, Sp, Sp, Sp)-Gs10Cs10Cs10Us10Cs10As10Gs10Us10Cs10Us10Gs10Cs10Us10Us10Cs10Gs10Cs1ACs10C | 5S-9R-4S |
| 203 | 111 | (Sp, Sp, Sp, Sp, Sp, Rp, Rp, Rp, Rp, Rp Rp, Rp, Rp, Rp, Sp, Sp, Sp, Sp)-Gs11Cs11Cs11Us11Cs11As11Gs11Us11Cs11Us11Gs11Cs11Us11Us11Cs11Gs11Cs1ACs11C | 5S-9R-4S |
| 204 | 111 | (Sp, Sp, Sp, Sp, Sp, Rp, Rp, Rp, Rp, Rp Rp, Rp, Rp, Rp, Sp, Sp, Sp, Sp)-Gs12Cs12Cs12Us12Cs12As12Gs12Us12Cs12Us12Gs12Cs12Us12Us12Cs12Gs12Cs1ACs12C | 5S-9R-4S |
| 205 | 111 | (Sp, Sp, Sp, Sp, Sp, Rp, Rp, Rp, Rp, Rp Rp, Rp, Rp, Rp, Sp, Sp, Sp, Sp)-Gs13Cs13Cs13Us13Cs13As13Gs13Us13Cs13Us13Gs13Cs13Us13Us13Cs13Gs13Cs1ACs13C | 5S-9R-4S |
| 206 | 111 | (Sp, Sp, Sp, Sp, Sp, Rp, Rp, Rp, Rp, Rp Rp, Rp, Rp, Rp, Sp, Sp, Sp, Sp)-Gs14Cs14Cs14Us14Cs14As14Gs14Us14Cs14Us14Gs14Cs14Us14Us14Cs14Gs14Cs1ACs14C | 5S-9R-4S |

TABLE 2-continued

Exemplary chirally controlled oligonucleotides.

| Oligo | SEQ ID NO: | Stereochemistry/Sequence | Description |
|---|---|---|---|
| 207 | 111 | (Sp, Sp, Sp, Sp, Sp, Rp, Rp, Rp, Rp, Rp Rp, Rp, Rp, Rp, Sp, Sp, Sp, Sp)-Gs15Cs15Cs15Us15Cs15As15Gs15Us15Cs15Us15Gs15Cs15Us15Us15Cs15Gs15Cs1ACs15C | 5S-9R-4S |

In some embodiments, a chirally controlled oligonucleotide is designed such that one or more nucleotides comprise a phosphorus modification prone to "autorelease" under certain conditions. That is, under certain conditions, a particular phosphorus modification is designed such that it self-cleaves from the oligonucleotide to provide, e.g., a phosphate diester such as those found in naturally occurring DNA and RNA. In some embodiments, such a phosphorus modification has a structure of —O-L-R$^1$, wherein each of L and R$^1$ is independently as defined above and described herein. In some embodiments, an autorelease group comprises a morpholino group. In some embodiments, an autorelease group is characterized by the ability to deliver an agent to the internucleotidic phosphorus linker, which agent facilitates further modification of the phosphorus atom such as, e.g., desulfurization. In some embodiments, the agent is water and the further modification is hydrolysis to form a phosphate diester as is found in naturally occurring DNA and RNA.

In some embodiments, a chirally controlled oligonucleotide is designed such that the resulting pharmaceutical properties are improved through one or more particular modifications at phosphorus. It is well documented in the art that certain oligonucleotides are rapidly degraded by nucleases and exhibit poor cellular uptake through the cytoplasmic cell membrane (Poijarvi-Virta et al., Curr. Med. Chem. (2006), 13(28); 3441-65; Wagner et al., Med. Res. Rev. (2000), 20(6):417-51; Peyrottes et al., Mini Rev. Med. Chem. (2004), 4(4):395-408; Gosselin et al., (1996), 43(1): 196-208; Bologna et al., (2002), Antisense & Nucleic Acid Drug Development 12:33-41). For instance, Vives et al., (Nucleic Acids Research (1999), 27(20):4071-76) found that tert-butyl SATE pro-oligonucleotides displayed markedly increased cellular penetration compared to the parent oligonucleotide.

In some embodiments, a modification at a linkage phosphorus is characterized by its ability to be transformed to a phosphate diester, such as those present in naturally occurring DNA and RNA, by one or more esterases, nucleases, and/or cytochrome P450 enzymes, including but not limited to, those listed in Table 3, below.

TABLE 3

Exemplary enzymes.

| Family | Gene |
|---|---|
| CYP1 | CYP1A1, CYP1A2, CYP1B1 |
| CYP2 | CYP2A6, CYP2A7, CYP2A13, CYP2B6, CYP2C8, CYP2C9, CYP2C18, CYP2C19, CYP2D6, CYP2E1, CYP2F1, CYP2J2, CYP2R1, CYP2S1, CYP2U1, CYP2W1 |
| CYP3 | CYP3A4, CYP3A5, CYP3A7, CYP3A43 |
| CYP4 | CYP4A11, CYP4A22, CYP4B1, CYP4F2, CYP4F3, CYP4F8, CYP4F11, CYP4F12, CYP4F22, CYP4V2, CYP4X1, CYP4Z1 |

TABLE 3-continued

Exemplary enzymes.

| Family | Gene |
|---|---|
| CYP5 | CYP5A1 |
| CYP7 | CYP7A1, CYP7B1 |
| CYP8 | CYP8A1 (prostacyclin synthase), CYP8B1 (bile acid biosynthesis) |
| CYP11 | CYP11A1, CYP11B1, CYP11B2 |
| CYP17 | CYP17A1 |
| CYP19 | CYP19A1 |
| CYP20 | CYP20A1 |
| CYP21 | CYP21A2 |
| CYP24 | CYP24A1 |
| CYP26 | CYP26A1, CYP26B1, CYP26C1 |
| CYP27 | CYP27A1 (bile acid biosynthesis), CYP27B1 (vitamin D3 1-alpha hydroxylase, activates vitamin D3), CYP27C1 (unknown function) |
| CYP39 | CYP39A1 |
| CYP46 | CYP46A1 |
| CYP51 | CYP51A1 (lanosterol 14-alpha demethylase) |

In some embodiments, a modification at phosphorus results in a P-modification moiety characterized in that it acts as a pro-drug, e.g., the P-modification moiety facilitates delivery of an oligonucleotide to a desired location prior to removal. For instance, in some embodiments, a P-modification moiety results from PEGylation at the linkage phosphorus. One of skill in the relevant arts will appreciate that various PEG chain lengths are useful and that the selection of chain length will be determined in part by the result that is sought to be achieved by PEGylation. For instance, in some embodiments, PEGylation is effected in order to reduce RES uptake and extend in vivo circulation lifetime of an oligonucleotide.

In some embodiments, a PEGylation reagent for use in accordance with the present invention is of a molecular weight of about 300 g/mol to about 100,000 g/mol. In some embodiments, a PEGylation reagent is of a molecular weight of about 300 g/mol to about 10,000 g/mol. In some embodiments, a PEGylation reagent is of a molecular weight of about 300 g/mol to about 5,000 g/mol. In some embodiments, a PEGylation reagent is of a molecular weight of about 500 g/mol. In some embodiments, a PEGylation reagent of a molecular weight of about 1000 g/mol. In some embodiments, a PEGylation reagent is of a molecular weight of about 3000 g/mol. In some embodiments, a PEGylation reagent is of a molecular weight of about 5000 g/mol.

In certain embodiments, a PEGylation reagent is PEG500. In certain embodiments, a PEGylation reagent is PEG1000. In certain embodiments, a PEGylation reagent is PEG3000. In certain embodiments, a PEGylation reagent is PEG5000.

In some embodiments, a P-modification moiety is characterized in that it acts as a PK enhancer, e.g., lipids, PEGylated lipids, etc.

In some embodiments, a P-modification moiety is characterized in that it acts as an agent which promotes cell entry and/or endosomal escape, such as a membrane-disruptive lipid or peptide.

In some embodiments, a P-modification moiety is characterized in that it acts as a targeting agent. In some embodiments, a P-modification moiety is or comprises a targeting agent. The phrase "targeting agent," as used herein, is an entity that is associates with a payload of interest (e.g., with an oligonucleotide or oligonucleotide composition) and also interacts with a target site of interest so that the payload of interest is targeted to the target site of interest when associated with the targeting agent to a materially greater extent than is observed under otherwise comparable conditions when the payload of interest is not associated with the targeting agent. A targeting agent may be, or comprise, any of a variety of chemical moieties, including, for example, small molecule moieties, nucleic acids, polypeptides, carbohydrates, etc. Targeting agents are described further by Adarsh et al., "Organelle Specific Targeted Drug Delivery—A Review," International Journal of Research in Pharmaceutical and Biomedical Sciences, 2011, p. 895.

Exemplary such targeting agents include, but are not limited to, proteins (e.g. Transferrin), oligopeptides (e.g., cyclic and acylic RGD-containing oligopedptides), antibodies (monoclonal and polyclonal antibodies, e.g. IgG, IgA, IgM, IgD, IgE antibodies), sugars/carbohydrates (e.g., monosaccharides and/or oligosaccharides (mannose, mannose-6-phosphate, galactose, and the like)), vitamins (e.g., folate), or other small biomolecules. In some embodiments, a targeting moiety is a steroid molecule (e.g., bile acids including cholic acid, deoxycholic acid, dehydrocholic acid; cortisone; digoxigenin; testosterone; cholesterol; cationic steroids such as cortisone having a trimethylaminomethyl hydrazide group attached via a double bond at the 3-position of the cortisone ring, etc.). In some embodiments, a targeting moiety is a lipophilic molecule (e.g., alicyclic hydrocarbons, saturated and unsaturated fatty acids, waxes, terpenes, and polyalicyclic hydrocarbons such as adamantine and buckminsterfullerenes). In some embodiments, a lipophilic molecule is a terpenoid such as vitamin A, retinoic acid, retinal, or dehydroretinal. In some embodiments, a targeting moiety is a peptide.

In some embodiments, a P-modification moiety is a targeting agent of formula —X-L-R$^1$ wherein each of X, L, and R$^1$ are as defined in Formula I above.

In some embodiments, a P-modification moiety is characterized in that it facilitates cell specific delivery.

In some embodiments, a P-modification moiety is characterized in that it falls into one or more of the above-described categories. For instance, in some embodiments, a P-modification moiety acts as a PK enhancer and a targeting ligand. In some embodiments, a P-modification moiety acts as a pro-drug and an endosomal escape agent. One of skill in the relevant arts would recognize that numerous other such combinations are possible and are contemplated by the present invention.

Nucleobases

In some embodiments, a nucleobase present in a provided oligonucleotide is a natural nucleobase or a modified nucleobase derived from a natural nucleobase. Examples include, but are not limited to, uracil, thymine, adenine, cytosine, and guanine having their respective amino groups protected by acyl protecting groups, 2-fluorouracil, 2-fluorocytosine, 5-bromouracil, 5-iodouracil, 2,6-diaminopurine, azacytosine, pyrimidine analogs such as pseudoisocytosine and pseudouracil and other modified nucleobases such as 8-substituted purines, xanthine, or hypoxanthine (the latter two being the natural degradation products). Exemplary modified nucleobases are disclosed in Chiu and Rana, RNA, 2003, 9, 1034-1048, Limbach et al. *Nucleic Acids Research,* 1994, 22, 2183-2196 and Revankar and Rao, *Comprehensive Natural Products Chemistry,* vol. 7, 313.

Compounds represented by the following general formulae are also contemplated as modified nucleobases:

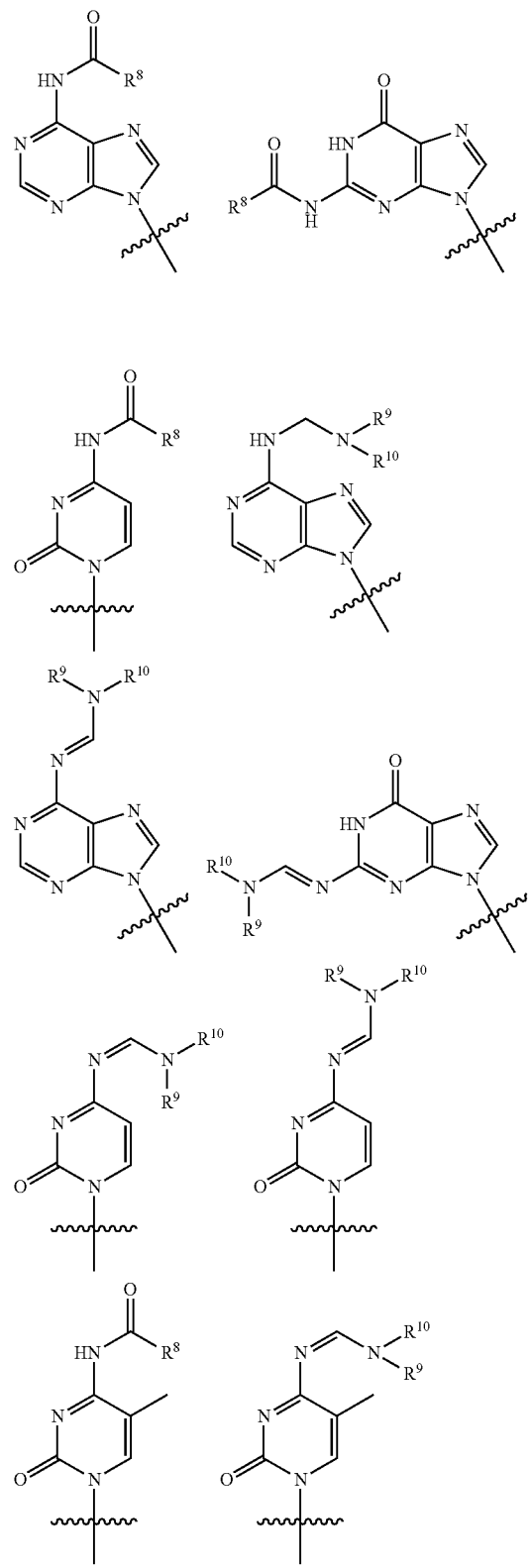

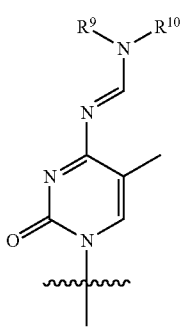

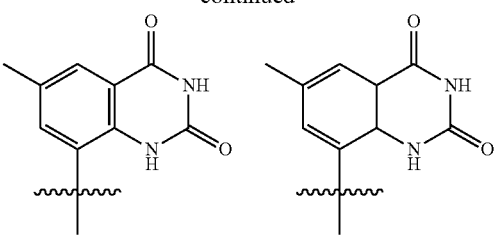

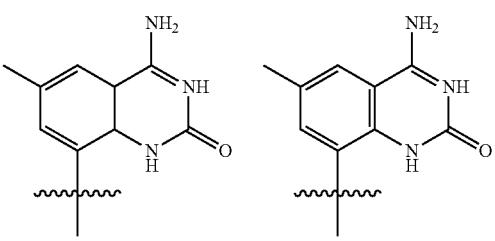

wherein $R^8$ is an optionally substituted, linear or branched group selected from aliphatic, aryl, aralkyl, aryloxylalkyl, carbocyclyl, heterocyclyl or heteroaryl group having 1 to 15 carbon atoms, including, by way of example only, a methyl, isopropyl, phenyl, benzyl, or phenoxymethyl group; and each of $R^9$ and $R^{10}$ is independently an optionally substituted group selected from linear or branched aliphatic, carbocyclyl, aryl, heterocyclyl and heteroaryl.

Modified nucleobases also include expanded-size nucleobases in which one or more aryl rings, such as phenyl rings, have been added. Nucleic base replacements described in the Glen Research catalog (www.glenresearch.com); Krueger A T et al, *Acc. Chem. Res.*, 2007, 40, 141-150; Kool, E T, *Acc. Chem. Res.*, 2002, 35, 936-943; Benner S. A., et al., *Nat. Rev. Genet.*, 2005, 6, 553-543; Romesberg, F. E., et al., *Curr. Opin. Chem. Biol.*, 2003, 7, 723-733; Hirao, I., *Curr. Opin. Chem. Biol.*, 2006, 10, 622-627, are contemplated as useful for the synthesis of the nucleic acids described herein. Some examples of these expanded-size nucleobases are shown below:

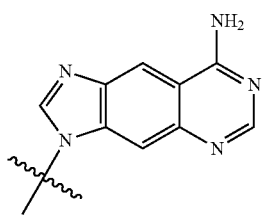

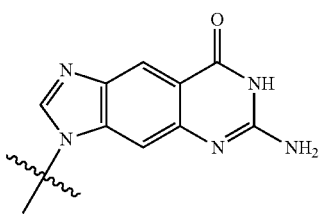

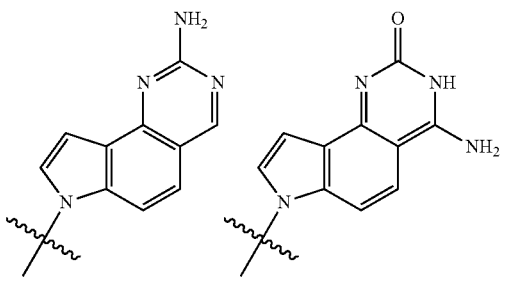

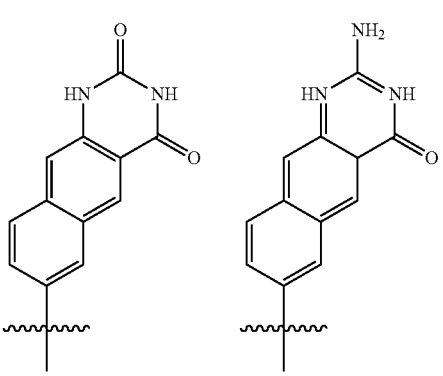

Herein, modified nucleobases also encompass structures that are not considered nucleobases but are other moieties such as, but not limited to, corrin- or porphyrin-derived rings. Porphyrin-derived base replacements have been described in Morales-Rojas, H and Kool, E T, *Org. Lett.*, 2002, 4, 4377-4380. Shown below is an example of a porphyrin-derived ring which can be used as a base replacement:

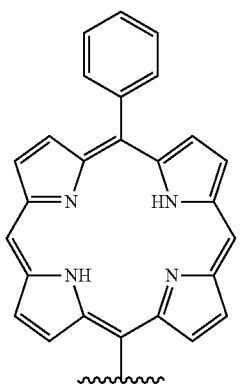 [SMILES: *c1c2nc(cc3ccc([nH]3)c(-c3ccccc3)c3nc(cc4ccc1[nH]4)C=C3)C=C2]

In some embodiments, modified nucleobases are of any one of the following structures, optionally substituted:

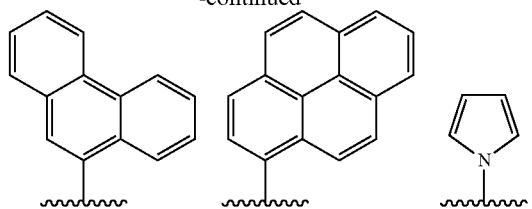

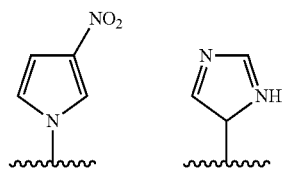

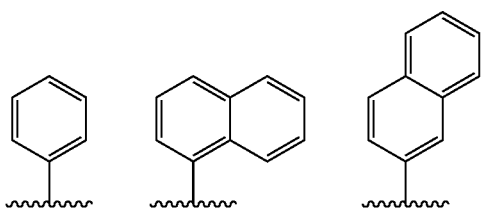

In some embodiments, a modified nucleobase is fluorescent. Exemplary such fluorescent modified nucleobases include phenanthrene, pyrene, stillbene, isoxanthine, isozanthopterin, terphenyl, terthiophene, benzoterthiophene, coumarin, lumazine, tethered stillbene, benzo-uracil, and naphtho-uracil, as shown below:

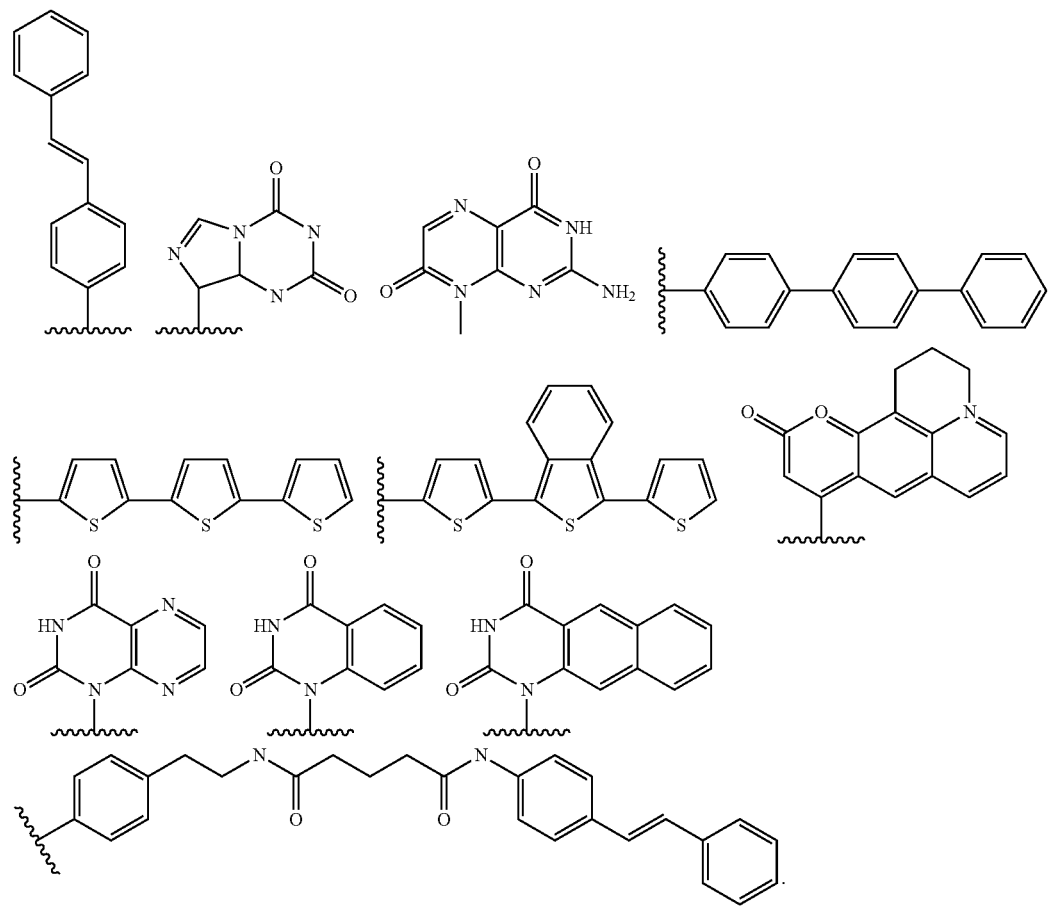

In some embodiments, a modified nucleobase is unsubstituted. In some embodiments, a modified nucleobase is substituted. In some embodiments, a modified nucleobase is substituted such that it contains, e.g., heteroatoms, alkyl groups, or linking moieties connected to fluorescent moieties, biotin or avidin moieties, or other protein or peptides. In some embodiments, a modified nucleobase is a "universal base" that is not a nucleobase in the most classical sense, but that functions similarly to a nucleobase. One representative example of such a universal base is 3-nitropyrrole.

In some embodiments, other nucleosides can also be used in the process disclosed herein and include nucleosides that incorporate modified nucleobases, or nucleobases covalently bound to modified sugars. Some examples of nucleosides that incorporate modified nucleobases include 4-acetylcytidine; 5-(carboxyhydroxylmethyl)uridine; 2'-O-methylcytidine; 5-carboxymethyl aminomethyl-2-thiouridine; 5-carboxymethylaminomethyluridine; dihydrouridine; 2'-O-methylpseudouridine; beta,D-galactosylqueosine; 2'-O-methylguanosine; $N^6$-isopentenyladenosine; 1-methyladenosine; 1-methylpseudouridine; 1-methylguanosine; 1-methylinosine; 2,2-dimethylguanosine; 2-methyladenosine; 2-methylguanosine; $N^7$-methylguanosine; 3-methyl-cytidine; 5-methylcytidine; 5-hydroxymethyl-cytidine; 5-formylcytosine; 5-carboxylcytosine; $N^6$-methyladenosine; 7-methylguanosine; 5-methylaminoethyluridine; 5-methoxyaminomethyl-2-thiouridine; beta,D-mannosylqueosine; 5-methoxycarbonylmethyluridine; 5-methoxyuridine; 2-methylthio-$N^6$-isopentenyladenosine; N-((9-beta,D-ribofuranosyl-2-methylthiopurine-6-yl)carbamoyl)threonine; N-((9-beta,D-ribofuranosylpurine-6-yl)-N-methylcarbamoyl)threonine; uridine-5-oxyacetic acid methylester; uridine-5-oxyacetic acid (v); pseudouridine; queosine; 2-thiocytidine; 5-methyl-2-thiouridine; 2-thiouridine; 4-thiouridine; 5-methyluridine; 2'-O-methyl-5-methyluridine; and 2'-O-methyluridine.

In some embodiments, nucleosides include 6'-modified bicyclic nucleoside analogs that have either (R) or (S)-chirality at the 6'-position and include the analogs described in U.S. Pat. No. 7,399,845. In other embodiments, nucleosides include 5'-modified bicyclic nucleoside analogs that have either (R) or (S)-chirality at the 5'-position and include the analogs described in US Patent Application Publication No. 20070287831.

In some embodiments, a nucleobase or modified nucleobase comprises one or more biomolecule binding moieties such as e.g., antibodies, antibody fragments, biotin, avidin, streptavidin, receptor ligands, or chelating moieties. In other embodiments, a nucleobase or modified nucleobase is 5-bromouracil, 5-iodouracil, or 2,6-diaminopurine. In some embodiments, a nucleobase or modified nucleobase is modified by substitution with a fluorescent or biomolecule binding moiety. In some embodiments, the substituent on a nucleobase or modified nucleobase is a fluorescent moiety. In some embodiments, the substituent on a nucleobase or modified nucleobase is biotin or avidin.

Representative U.S. patents that teach the preparation of certain of the above noted modified nucleobases as well as other modified nucleobases include, but are not limited to, the above noted U.S. Pat. No. 3,687,808, as well as U.S. Pat. Nos. 4,845,205; 5,130,30; 5,134,066; 5,175,273; 5,367,066; 5,432,272; 5,457,187; 5,457,191; 5,459,255; 5,484,908; 5,502,177; 5,525,711; 5,552,540; 5,587,469; 5,594,121; 5,596,091; 5,614,617; 5,681,941; 5,750,692; 6,015,886; 6,147,200; 6,166,197; 6,222,025; 6,235,887; 6,380,368; 6,528,640; 6,639,062; 6,617,438; 7,045,610; 7,427,672; and 7,495,088, each of which is herein incorporated by reference in its entirety.

Sugars

The most common naturally occurring nucleotides are comprised of ribose sugars linked to the nucleobases adenosine (A), cytosine (C), guanine (G), and thymine (T) or uracil (U). Also contemplated are modified nucleotides wherein a phosphate group or linkage phosphorus in the nucleotides can be linked to various positions of a sugar or modified sugar. As non-limiting examples, the phosphate group or linkage phosphorus can be linked to the 2', 3', 4' or 5' hydroxyl moiety of a sugar or modified sugar. Nucleotides that incorporate modified nucleobases as described herein are also contemplated in this context. In some embodiments, nucleotides or modified nucleotides comprising an unprotected —OH moiety are used in accordance with methods of the present invention.

Other modified sugars can also be incorporated within a provided oligonucleotide. In some embodiments, a modified sugar contains one or more substituents at the 2' position including one of the following: —F; —CF$_3$, —CN, —N$_3$, —NO, —NO$_2$, —OR', —SR', or —N(R')$_2$, wherein each R' is independently as defined above and described herein; —O—(C$_1$-C$_{10}$ alkyl), —S—(C$_1$-C$_{10}$ alkyl), —NH—(C$_1$-C$_{10}$ alkyl), or —N(C$_1$-C$_{10}$ alkyl)$_2$; —O—(C$_2$-C$_{10}$ alkenyl), —S—(C$_2$-C$_{10}$ alkenyl), —NH—(C$_2$-C$_{10}$ alkenyl), or —N(C$_2$-C$_{10}$ alkenyl)$_2$; —O—(C$_2$-C$_{10}$ alkynyl), —S—(C$_2$-C$_{10}$ alkynyl), —NH—(C$_2$-C$_{10}$ alkynyl), or —N(C$_2$-C$_{10}$ alkynyl)$_2$; or —O—(C$_1$-C$_{10}$ alkylene)-O—(C$_1$-C$_{10}$ alkyl), —O—(C$_1$-C$_{10}$ alkylene)-NH—(C$_1$-C$_{10}$ alkyl) or —O—(C$_1$-C$_{10}$ alkylene)-NH(C$_1$-C$_{10}$ alkyl)$_2$, —NH—(C$_1$-C$_{10}$ alkylene)-O—(C$_1$-C$_{10}$ alkyl), or —N(C$_1$-C$_{10}$ alkyl)-(C$_1$-C$_{10}$ alkylene)-O—(C$_1$-C$_{10}$ alkyl), wherein the alkyl, alkylene, alkenyl and alkynyl may be substituted or unsubstituted. Examples of substituents include, and are not limited to, —O(CH$_2$)$_n$OCH$_3$, and —O(CH$_2$)$_n$NH$_2$, wherein n is from 1 to about 10, MOE, DMAOE, DMAEOE. Also contemplated herein are modified sugars described in WO 2001/088198; and Martin et al., *Helv. Chim. Acta*, 1995, 78, 486-504. In some embodiments, a modified sugar comprises one or more groups selected from a substituted silyl group, an RNA cleaving group, a reporter group, a fluorescent label, an intercalator, a group for improving the pharmacokinetic properties of a nucleic acid, a group for improving the pharmacodynamic properties of a nucleic acid, or other substituents having similar properties. In some embodiments, modifications are made at one or more of the the 2', 3', 4', 5', or 6' positions of the sugar or modified sugar, including the 3' position of the sugar on the 3'-terminal nucleotide or in the 5' position of the 5'-terminal nucleotide.

In some embodiments, the 2'-OH of a ribose is replaced with a substituent including one of the following: —H, —F; —CF$_3$, —CN, —N$_3$, —NO, —NO$_2$, —OR', —SR', or —N(R')$_2$, wherein each R' is independently as defined above and described herein; —O—(C$_1$-C$_{10}$ alkyl), —S—(C$_1$-C$_{10}$ alkyl), —NH—(C$_1$-C$_{10}$ alkyl), or —N(C$_1$-C$_{10}$ alkyl)$_2$; —O—(C$_2$-C$_{10}$ alkenyl), —S—(C$_2$-C$_{10}$ alkenyl), —NH—(C$_2$-C$_{10}$ alkenyl), or —N(C$_2$-C$_{10}$ alkenyl)$_2$; —O—(C$_2$-C$_{10}$ alkynyl), —S—(C$_2$-C$_{10}$ alkynyl), —NH—(C$_2$-C$_{10}$ alkynyl), or —N(C$_2$-C$_{10}$ alkynyl)$_2$; or —O—(C$_1$-C$_{10}$ alkylene)-O—(C$_1$-C$_{10}$ alkyl), —O—(C$_1$-C$_{10}$ alkylene)-NH—(C$_1$-C$_{10}$ alkyl) or —O—(C$_1$-C$_{10}$ alkylene)-NH(C$_1$-C$_{10}$ alkyl)$_2$, —NH—(C$_1$-C$_{10}$ alkylene)-O—(C$_1$-C$_{10}$ alkyl), or —N(C$_1$-C$_{10}$ alkyl)-(C$_1$-C$_{10}$ alkylene)-O—(C$_1$-C$_{10}$ alkyl), wherein the alkyl, alkylene, alkenyl and alkynyl may be substituted or unsubstituted. In some embodiments, the 2'-OH is replaced with —H (deoxyribose). In some embodiments, the 2'-OH is replaced with —F. In some embodiments, the 2'-OH is replaced with —OR'. In some embodiments, the 2'-OH is replaced with —OMe. In some embodiments, the 2'-OH is replaced with —OCH$_2$CH$_2$OMe.

Modified sugars also include locked nucleic acids (LNAs). In some embodiments, the locked nucleic acid has the structure indicated below. A locked nucleic acid of the structure below is indicated, wherein Ba represents a nucleobase or modified nucleobase as described herein, and wherein R$^{2s}$ is —OCH$_2$C4'-.

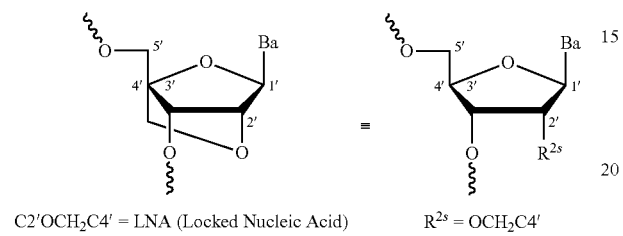

C2'OCH$_2$C4' = LNA (Locked Nucleic Acid)    R$^{2s}$ = OCH$_2$C4'

In some embodiments, a modified sugar is an ENA such as those described in, e.g., Seth et al., J Am Chem Soc. 2010 Oct. 27; 132(42): 14942-14950. In some embodiments, a modified sugar is any of those found in an XNA (xenonucleic acid), for instance, arabinose, anhydrohexitol, threose, 2'fluoroarabinose, or cyclohexene.

Modified sugars include sugar mimetics such as cyclobutyl or cyclopentyl moieties in place of the pentofuranosyl sugar. Representative United States patents that teach the preparation of such modified sugar structures include, but are not limited to, U.S. Pat. Nos. 4,981,957; 5,118,800; 5,319,080; and 5,359,044. Some modified sugars that are contemplated include sugars in which the oxygen atom within the ribose ring is replaced by nitrogen, sulfur, selenium, or carbon. In some embodiments, a modified sugar is a modified ribose wherein the oxygen atom within the ribose ring is replaced with nitrogen, and wherein the nitrogen is optionally substituted with an alkyl group (e.g., methyl, ethyl, isopropyl, etc).

Non-limiting examples of modified sugars include glycerol, which form glycerol nucleic acid (GNA) analogues. One example of a GNA analogue is shown below and is described in Zhang, R et al., *J. Am. Chem. Soc.*, 2008, 130, 5846-5847; Zhang L, et al., *J. Am. Chem. Soc.*, 2005, 127, 4174-4175 and Tsai C H et al., *PNAS*, 2007, 14598-14603 (X=O$^-$):

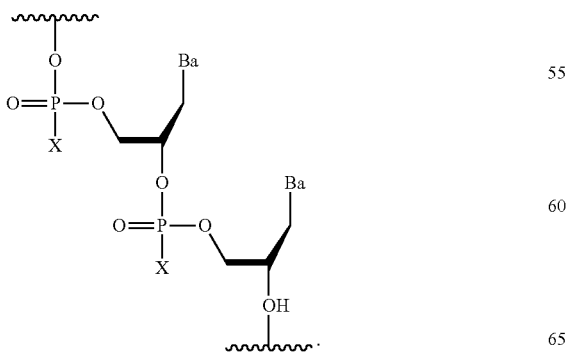

Another example of a GNA derived analogue, flexible nucleic acid (FNA) based on the mixed acetal aminal of formyl glycerol, is described in Joyce G F et al., *PNAS*, 1987, 84, 4398-4402 and Heuberger B D and Switzer C, *J. Am. Chem. Soc.*, 2008, 130, 412-413, and is shown below:

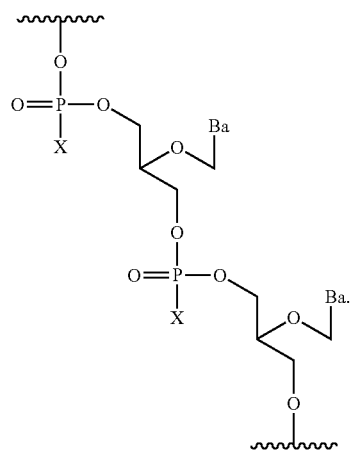

Additional non-limiting examples of modified sugars include hexopyranosyl (6' to 4'), pentopyranosyl (4' to 2'), pentopyranosyl (4' to 3'), or tetrofuranosyl (3' to 2') sugars. In some embodiments, a hexopyranosyl (6' to 4') sugar is of any one of the following formulae:

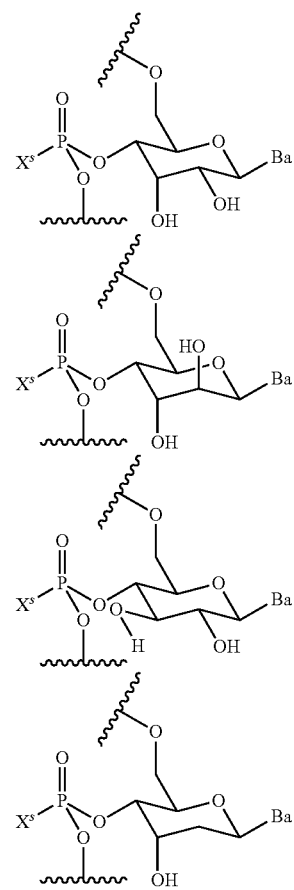

-continued

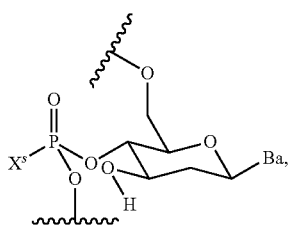

wherein $X^s$ corresponds to the P-modification group "—XLR$^1$" described herein and Ba is as defined herein.

In some embodiments, a pentopyranosyl (4' to 2') sugar is of any one of the following formulae:

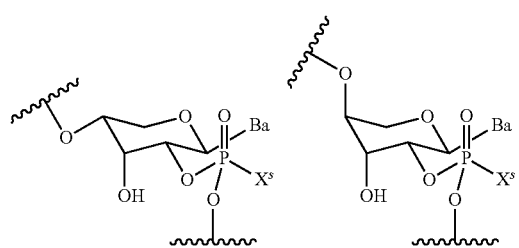

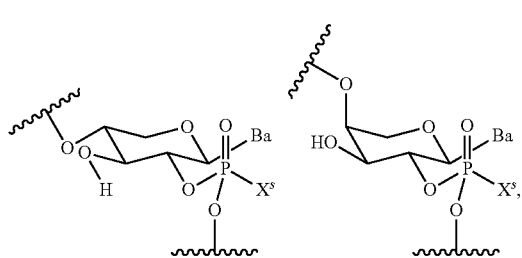

wherein $X^s$ corresponds to the P-modification group "—XLR$^1$" described herein and Ba is as defined herein.

In some embodiments, a pentopyranosyl (4' to 3') sugar is of any one of the following formulae:

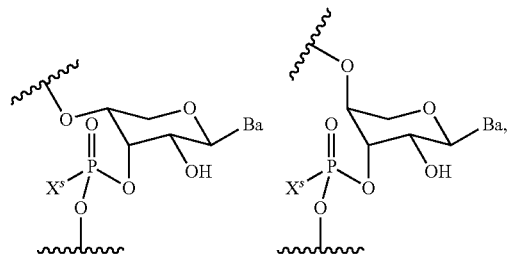

wherein $X^s$ corresponds to the P-modification group "—XLR$^1$" described herein and Ba is as defined herein.

In some embodiments, a tetrofuranosyl (3' to 2') sugar is of either of the following formulae:

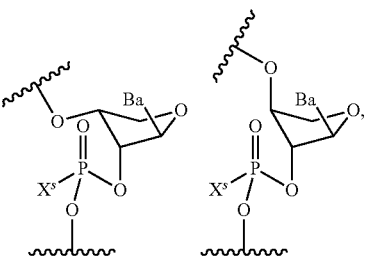

wherein $X^s$ corresponds to the P-modification group "—XLR$^1$" described herein and Ba is as defined herein.

In some embodiments, a modified sugar is of any one of the following formulae:

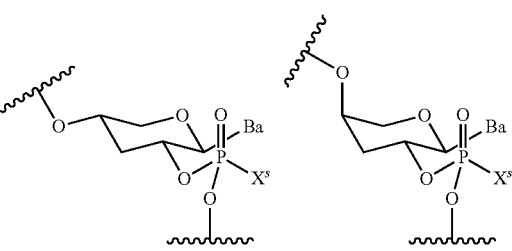

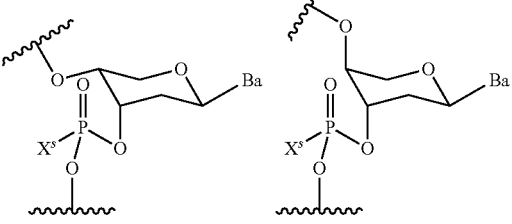

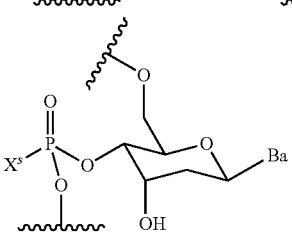

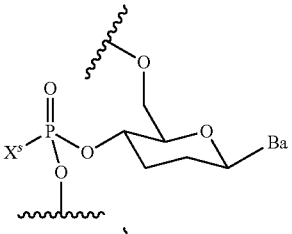

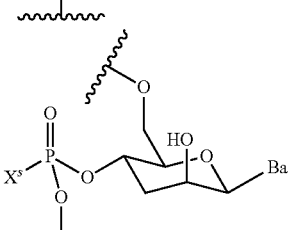

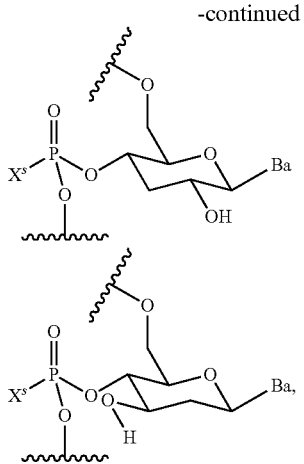

wherein $X^s$ corresponds to the P-modification group "—XLR" described herein and Ba is as defined herein.

In some embodiments, one or more hydroxyl group in a sugar moiety is optionally and independently replaced with halogen, R'—N(R')$_2$, —OR', or —SR', wherein each R' is independently as defined above and described herein.

In some embodiments, a sugar mimetic is as illustrated below, wherein X corresponds to the P-modification group "—XLR$^1$" described herein, Ba is as defined herein, and $X^1$ is selected from —S—, —Se—, —CH$_2$—, —NMe-, —NEt- or —NiPr—.

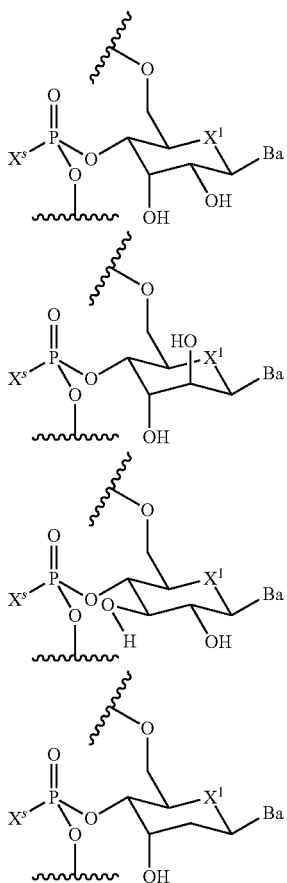

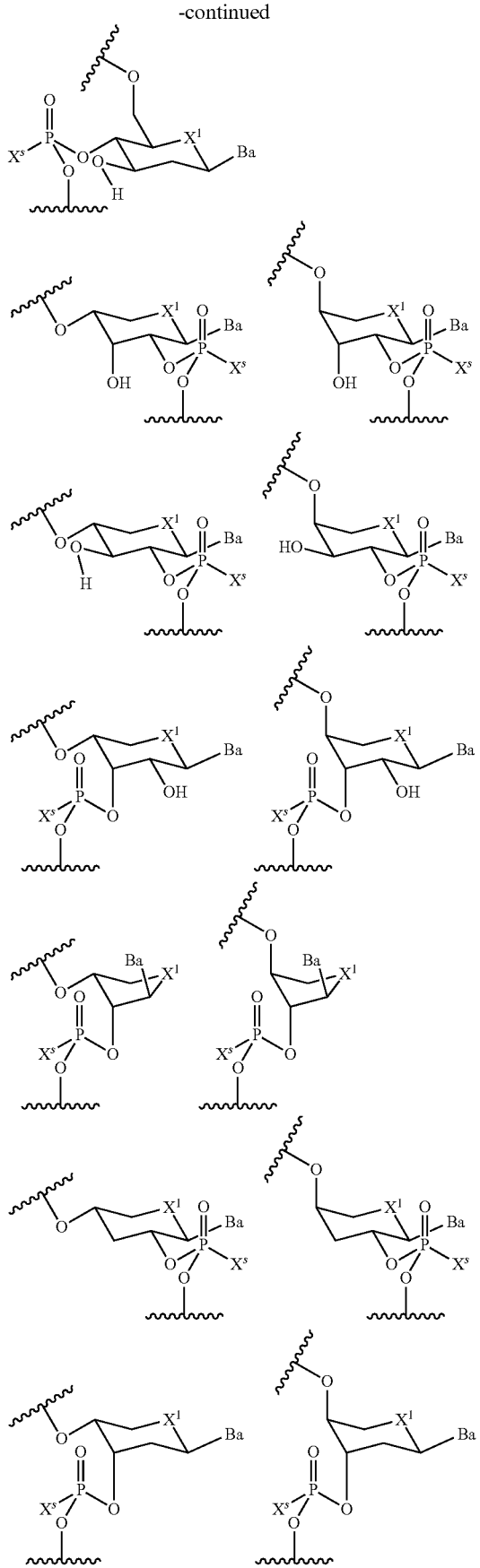

-continued

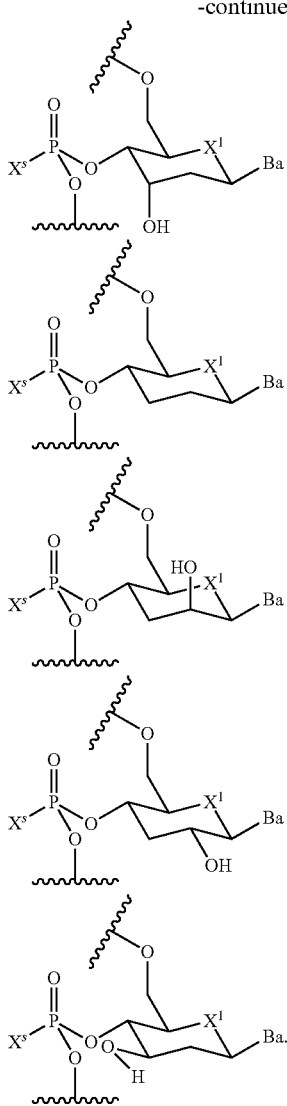

In some embodiments, at least 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50% or more (e.g., 55%, 60%, 65%, 70%, 75%, 80%, 85%, 90%, 95% or more), inclusive, of the sugars in a chirally controlled oligonucleotide composition are modified. In some embodiments, only purine residues are modified (e.g., about 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50% or more [e.g., 55%, 60%, 65%, 70%, 75%, 80%, 85%, 90%, 95% or more] of the purine residues are modified). In some embodiments, only pyrimidine residues are modified (e.g., about 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50% or more [e.g., 55%, 60%, 65%, 70%, 75%, 80%, 85%, 90%, 95% or more] of the pyridimine residues are modified). In some embodiments, both purine and pyrimidine residues are modified.

Modified sugars and sugar mimetics can be prepared by methods known in the art, including, but not limited to: A. Eschenmoser, Science (1999), 284:2118; M. Bohringer et al, Helv. Chim. Acta (1992), 75:1416-1477; M. Egli et al, J. Am. Chem. Soc. (2006), 128(33):10847-56; A. Eschenmoser in Chemical Synthesis: Gnosis to Prognosis, C. Chatgilialoglu and V. Sniekus, Ed., (Kluwer Academic, Netherlands, 1996), p. 293; K.-U. Schoning et al, Science (2000), 290:1347-1351; A. Eschenmoser et al, Helv. Chim. Acta (1992), 75:218; J. Hunziker et al, Helv. Chim. Acta (1993), 76:259; G. Otting et al, Helv. Chim. Acta (1993), 76:2701; K. Groebke et al, Helv. Chim. Acta (1998), 81:375; and A. Eschenmoser, Science (1999), 284:2118. Modifications to the 2' modifications can be found in Verma, S. et al. Annu. Rev. Biochem. 1998, 67, 99-134 and all references therein. Specific modifications to the ribose can be found in the following references: 2'-fluoro (Kawasaki et. al., J. Med. Chem., 1993, 36, 831-841), 2'-MOE (Martin, P. Helv. Chim. Acta 1996, 79, 1930-1938), "LNA" (Wengel, J. Acc. Chem. Res. 1999, 32, 301-310). In some embodiments, a modified sugar is any of those described in PCT Publication No. WO2012/030683, incorporated herein by reference, and depicted in the FIGS. 26-30 of the present application.

Oligonucleotides

In some embodiments, the present invention provides oligonucleotides and oligonucleotide compositions that are chirally controlled. For instance, in some embodiments, a provided composition contains predetermined levels of one or more individual oligonucleotide types, wherein an oligonucleotide type is defined by: 1) base sequence; 2) pattern of backbone linkages; 3) pattern of backbone chiral centers; and 4) pattern of backbone P-modifications.

In some embodiments, a provided oligonucleotide is a unimer. In some embodiments, a provided oligonucleotide is a P-modification unimer. In some embodiments, a provided oligonucleotide is a stereounimer. In some embodiments, a provided oligonucleotide is a stereounimer of configuration Rp. In some embodiments, a provided oligonucleotide is a stereounimer of configuration Sp.

In some embodiments, a provided oligonucleotide is an altmer. In some embodiments, a provided oligonucleotide is a P-modification altmer. In some embodiments, a provided oligonucleotide is a stereoaltmer.

In some embodiments, a provided oligonucleotide is a blockmer. In some embodiments, a provided oligonucleotide is a P-modification blockmer. In some embodiments, a provided oligonucleotide is a stereoblockmer.

In some embodiments, a provided oligonucleotide is a gapmer.

In some embodiments, a provided oligonucleotide is a skipmer.

In some embodiments, a provided oligonucleotide is a combination of one or more of unimer, altmer, blockmer, gapmer, and skipmer. For instance, in some embodiments, a provided oligonucleotide is both an altmer and a gapmer. In some embodiments, a provided nucleotide is both a gapmer and a skipmer. One of skill in the chemical and synthetic arts will recognize that numerous other combinations of patterns are available and are limited only by the commercial availability and/or synthetic accessibility of constituent parts required to synthesize a provided oligonucleotide in accordance with methods of the present invention.

In some embodiments, a provided oligonucleotide comprises one or more optionally substituted nucleotides. In some embodiments, a provided oligonucleotide comprises one or more modified nucleotides. In some embodiments, a provided oligonucleotide comprises one or more optionally substituted nucleosides. In some embodiments, a provided oligonucleotide comprises one or more modified nucleosides. In some embodiments, a provided oligonucleotide comprises one or more optionally substituted LNAs.

In some embodiments, a provided oligonucleotide comprises one or more optionally substituted nucleobases. In some embodiments, a provided oligonucleotide comprises one or more optionally substituted natural nucleobases. In some embodiments, a provided oligonucleotide comprises one or more optionally substituted modified nucleobases. In some embodiments, a provided oligonucleotide comprises one or more 5-methylcytidine; 5-hydroxymethylcytidine, 5-formylcytosine, or 5-carboxylcytosine. In some embodiments, a provided oligonucleotide comprises one or more 5-methylcytidine.

In some embodiments, a provided oligonucleotide comprises one or more optionally substituted sugars. In some embodiments, a provided oligonucleotide comprises one or more optionally substituted sugars found in naturally occurring DNA and RNA. In some embodiments, a provided oligonucleotide comprises one or more optionally substituted ribose or deoxyribose. In some embodiments, a provided oligonucleotide comprises one or more optionally substituted ribose or deoxyribose, wherein one or more hydroxyl groups of the ribose or deoxyribose moiety is optionally and independently replaced by halogen, R', —N(R')$_2$, —OR', or —SR', wherein each R' is independently as defined above and described herein. In some embodiments, a provided oligonucleotide comprises one or more optionally substituted deoxyribose, wherein the 2' position of the deoxyribose is optionally and independently substituted with halogen, R', —N(R')$_2$, —OR', or —SR', wherein each R' is independently as defined above and described herein. In some embodiments, a provided oligonucleotide comprises one or more optionally substituted deoxyribose, wherein the 2' position of the deoxyribose is optionally and independently substituted with halogen. In some embodiments, a provided oligonucleotide comprises one or more optionally substituted deoxyribose, wherein the 2' position of the deoxyribose is optionally and independently substituted with one or more —F. halogen. In some embodiments, a provided oligonucleotide comprises one or more optionally substituted deoxyribose, wherein the 2' position of the deoxyribose is optionally and independently substituted with —OR', wherein each R' is independently as defined above and described herein. In some embodiments, a provided oligonucleotide comprises one or more optionally substituted deoxyribose, wherein the 2' position of the deoxyribose is optionally and independently substituted with —OR', wherein each R' is independently an optionally substituted $C_1$-$C_6$ aliphatic. In some embodiments, a provided oligonucleotide comprises one or more optionally substituted deoxyribose, wherein the 2' position of the deoxyribose is optionally and independently substituted with —OR', wherein each R' is independently an optionally substituted $C_1$-$C_6$ alkyl. In some embodiments, a provided oligonucleotide comprises one or more optionally substituted deoxyribose, wherein the 2' position of the deoxyribose is optionally and independently substituted with —OMe. In some embodiments, a provided oligonucleotide comprises one or more optionally substituted deoxyribose, wherein the 2' position of the deoxyribose is optionally and independently substituted with —O-methoxyethyl.

In some embodiments, a provided oligonucleotide is single-stranded oligonucleotide.

In some embodiments, a provided oligonucleotide is a hybridized oligonucleotide strand. In certain embodiments, a provided oligonucleotide is a partially hybridized oligonucleotide strand. In certain embodiments, a provided oligonucleotide is a completely hybridized oligonucleotide strand. In certain embodiments, a provided oligonucleotide is a double-stranded oligonucleotide. In certain embodiments, a provided oligonucleotide is a triple-stranded oligonucleotide (e.g., a triplex).

In some embodiments, a provided oligonucleotide is chimeric. For example, in some embodiments, a provided oligonucleotide is DNA-RNA chimera, DNA-LNA chimera, etc.

In some embodiments, any one of the structures comprising an oligonucleotide depicted in WO2012/030683 can be modified in accordance with methods of the present invention to provide chirally controlled variants thereof. For example, in some embodiments the chirally controlled variants comprise a stereochemical modification at any one or more of the linkage phosphorus and/or a P-modification at any one or more of the linkage phosphorus. For example, in some embodiments, a particular nucleotide unit of a oligonucleotide of WO2012/030683 is preselected to be stereochemically modified at the linkage phosphorus of that nucleotide unit and/or P-modified at the linkage phosphorus of that nucleotide unit. In some embodiments, a chirally controlled oligonucleotide is of any one of the structures depicted in FIGS. 26-30. In some embodiments, a chirally controlled oligonucleotide is a variant (e.g., modified version) of any one of the structures depicted in FIGS. 26-30. The disclosure of WO2012/030683 is herein incorporated by reference in its entirety.

In some embodiments, a provided oligonucleotide is a therapeutic agent.

In some embodiments, a provided oligonucleotide is an antisense oligonucleotide.

In some embodiments, a provided oligonucleotide is an antigene oligonucleotide.

In some embodiments, a provided oligonucleotide is a decoy oligonucleotide.

In some embodiments, a provided oligonucleotide is part of a DNA vaccine.

In some embodiments, a provided oligonucleotide is an immunomodulatory oligonucleotide, e.g., immunostimulatory oligonucleotide and immunoinhibitory oligonucleotide.

In some embodiments, a provided oligonucleotide is an adjuvant.

In some embodiments, a provided oligonucleotide is an aptamer.

In some embodiments, a provided oligonucleotide is a ribozyme.

In some embodiments, a provided oligonucleotide is a deoxyribozyme (DNAzymes or DNA enzymes).

In some embodiments, a provided oligonucleotide is an siRNA.

In some embodiments, a provided oligonucleotide is a microRNA, or miRNA.

In some embodiments, a provided oligonucleotide is a ncRNA (non-coding RNAs), including a long non-coding RNA (lncRNA) and a small non-coding RNA, such as piwi-interacting RNA (piRNA).

In some embodiments, a provided oligonucleotide is complementary to a structural RNA, e.g., tRNA.

In some embodiments, a provided oligonucleotide is a nucleic acid analog, e.g., GNA, LNA, PNA, TNA and Morpholino.

In some embodiments, a provided oligonucleotide is a P-modified prodrug.

In some embodiments, a provided oligonucleotide is a primer. In some embodiments, a primers is for use in polymerase-based chain reactions (i.e., PCR) to amplify nucleic acids. In some embodiments, a primer is for use in any known variations of PCR, such as reverse transcription PCR (RT-PCR) and real-time PCR.

In some embodiments, a provided oligonucleotide is characterized as having the ability to modulate RNase H activation. For example, in some embodiments, RNase H activation is modulated by the presence of stereocontrolled phosphorothioate nucleic acid analogs, with natural DNA/RNA being more or equally susceptible than the Rp stereoisomer, which in turn is more susceptible than the corresponding Sp stereoisomer.

In some embodiments, a provided oligonucleotide is characterized as having the ability to indirectly or directly increase or decrease activity of a protein or inhibition or promotion of the expression of a protein. In some embodiments, a provided oligonucleotide is characterized in that it is useful in the control of cell proliferation, viral replication, and/or any other cell signaling process.

In some embodiments, a provided oligonucleotide is from about 2 to about 200 nucleotide units in length. In some embodiments, a provided oligonucleotide is from about 2 to about 180 nucleotide units in length. In some embodiments, a provided oligonucleotide is from about 2 to about 160 nucleotide units in length. In some embodiments, a provided oligonucleotide is from about 2 to about 140 nucleotide units in length. In some embodiments, a provided oligonucleotide is from about 2 to about 120 nucleotide units in length. In some embodiments, a provided oligonucleotide is from about 2 to about 100 nucleotide units in length. In some embodiments, a provided oligonucleotide is from about 2 to about 90 nucleotide units in length. In some embodiments, a provided oligonucleotide is from about 2 to about 80 nucleotide units in length. In some embodiments, a provided oligonucleotide is from about 2 to about 70 nucleotide units in length. In some embodiments, a provided oligonucleotide is from about 2 to about 60 nucleotide units in length. In some embodiments, a provided oligonucleotide is from about 2 to about 50 nucleotide units in length. In some embodiments, a provided oligonucleotide is from about 2 to about 40 nucleotide units in length. In some embodiments, a provided oligonucleotide is from about 2 to about 30 nucleotide units in length. In some embodiments, a provided oligonucleotide is from about 2 to about 29 nucleotide units in length. In some embodiments, a provided oligonucleotide is from about 2 to about 28 nucleotide units in length. In some embodiments, a provided oligonucleotide is from about 2 to about 27 nucleotide units in length. In some embodiments, a provided oligonucleotide is from about 2 to about 26 nucleotide units in length. In some embodiments, a provided oligonucleotide is from about 2 to about 25 nucleotide units in length. In some embodiments, a provided oligonucleotide is from about 2 to about 24 nucleotide units in length. In some embodiments, a provided oligonucleotide is from about 2 to about 23 nucleotide units in length. In some embodiments, a provided oligonucleotide is from about 2 to about 22 nucleotide units in length. In some embodiments, a provided oligonucleotide is from about 2 to about 21 nucleotide units in length. In some embodiments, a provided oligonucleotide is from about 2 to about 20 nucleotide units in length.

In some embodiments, a provided oligonucleotide is from about 4 to about 200 nucleotide units in length. In some embodiments, a provided oligonucleotide is from about 4 to about 180 nucleotide units in length. In some embodiments, a provided oligonucleotide is from about 4 to about 160 nucleotide units in length. In some embodiments, a provided oligonucleotide is from about 4 to about 140 nucleotide units in length. In some embodiments, a provided oligonucleotide is from about 4 to about 120 nucleotide units in length. In some embodiments, a provided oligonucleotide is from about 4 to about 100 nucleotide units in length. In some embodiments, a provided oligonucleotide is from about 4 to about 90 nucleotide units in length. In some embodiments, a provided oligonucleotide is from about 4 to about 80 nucleotide units in length. In some embodiments, a provided oligonucleotide is from about 4 to about 70 nucleotide units in length. In some embodiments, a provided oligonucleotide is from about 4 to about 60 nucleotide units in length. In some embodiments, a provided oligonucleotide is from about 4 to about 50 nucleotide units in length. In some embodiments, a provided oligonucleotide is from about 4 to about 40 nucleotide units in length. In some embodiments, a provided oligonucleotide is from about 4 to about 30 nucleotide units in length. In some embodiments, a provided oligonucleotide is from about 4 to about 29 nucleotide units in length. In some embodiments, a provided oligonucleotide is from about 4 to about 28 nucleotide units in length. In some embodiments, a provided oligonucleotide is from about 4 to about 27 nucleotide units in length. In some embodiments, a provided oligonucleotide is from about 4 to about 26 nucleotide units in length. In some embodiments, a provided oligonucleotide is from about 4 to about 25 nucleotide units in length. In some embodiments, a provided oligonucleotide is from about 4 to about 24 nucleotide units in length. In some embodiments, a provided oligonucleotide is from about 4 to about 23 nucleotide units in length. In some embodiments, a provided oligonucleotide is from about 4 to about 22 nucleotide units in length. In some embodiments, a provided oligonucleotide is from about 4 to about 21 nucleotide units in length. In some embodiments, a provided oligonucleotide is from about 4 to about 20 nucleotide units in length.

In some embodiments, a provided oligonucleotide is from about 5 to about 10 nucleotide units in length. In some embodiments, a provided oligonucleotide is from about 10 to about 30 nucleotide units in length. In some embodiments, a provided oligonucleotide is from about 15 to about 25 nucleotide units in length. In some embodiments, a provided oligonucleotide is from about 5, 6, 7, 8, 9, 10, 11, 12, 13, 14, 15, 16, 17, 18, 19, 20, 21, 22, 23, 24, or 25 nucleotide units in length.

In some embodiments, the oligonucleotide is at least 2 nucleotide units in length. In some embodiments, the oligonucleotide is at least 3 nucleotide units in length. In some embodiments, the oligonucleotide is at least 4 nucleotide units in length. In some embodiments, the oligonucleotide is at least 5 nucleotide units in length. In some embodiments, the oligonucleotide is at least 6 nucleotide units in length. In some embodiments, the oligonucleotide is at least 7 nucleotide units in length. In some embodiments, the oligonucleotide is at least 8 nucleotide units in length. In some embodiments, the oligonucleotide is at least 9 nucleotide units in length. In some embodiments, the oligonucleotide is at least 10 nucleotide units in length. In some embodiments, the oligonucleotide is at least 11 nucleotide units in length.

In some embodiments, the oligonucleotide is at least 12 nucleotide units in length. In some embodiments, the oligonucleotide is at least 15 nucleotide units in length. In some embodiments, the oligonucleotide is at least 20 nucleotide units in length. In some embodiments, the oligonucleotide is at least 25 nucleotide units in length. In some other embodiments, the oligonucleotide is at least 30 nucleotide units in length. In some other embodiments, the oligonucleotide is a duplex of complementary strands of at least 18 nucleotide units in length. In some other embodiments, the oligonucleotide is a duplex of complementary strands of at least 21 nucleotide units in length.

In some embodiments, the 5'-end and/or the 3'-end of a provided oligonucleotide is modified. In some embodiments, the 5'-end and/or the 3'-end of a provided oligonucleotide is modified with a terminal cap moiety. Exemplary such modifications, including terminal cap moieties are extensively described herein and in the art, for example but not limited to those described in US Patent Application Publication US 2009/0023675A1.

Species of Oligonucleotides

In certain embodiments, an oligonucleotide of formula I is of any one of the structures shown in Table 2, above and those described in the examples.

In some embodiments, a provided chirally controlled oligonucleotide comprises the sequence of, or part of the sequence of mipomersen. Mipomersen is based on the following base sequence GCCT/UCAGT/UCT/UGCT/UT/UCGCACC (SEQ ID NO: 112). In some embodiments, one or more of any of the nucleotide or linkages may be modified in accordance of the present invention. In some embodiments, the present invention provides a chirally controlled oligonucleotide having the sequence of G*-C*-C*-U*-C*-dA-dG-dT-dC-dT-dG-dmC-dT-dT-dmC-G*-C*-A*-C*-C* (SEQ ID NO: 113) [d=2'-deoxy, *=2'-O-(2-methoxyethyl)] with 3'→5' phosphorothioate linkages. Exemplary modified mipomersen sequences are described throughout the application, including but not limited to those in Table 4.

In certain embodiments, a provided oligonucleotide is a mipomersen unimer. In certain embodiments, a provided oligonucleotide is a mipomersen unimer of configuration Rp. In certain embodiments, a provided oligonucleotide is a mipomersen unimer of configuration Sp.

Exemplary chirally controlled oligonucleotides comprising the sequence of, or part of the sequence of mipomersen is depicted in Table 4, below.

TABLE 4

Exemplary Mipomersen related sequences.

| Oligo | SEQ ID NO: | Stereochemistry/Sequence | Description |
|---|---|---|---|
| 101 | 106 | All-(Rp)-d[GsCsCsTsCsAsGsTsCsTsGsCsTsTsCsGsCsAsCsC] | All-R |
| 102 | 106 | All-(Sp)-d[GsCsCsTsCsAsGsTsCsTsGsCsTsTsCsGsCsAsCsC] | All-S |
| 103 | 106 | (Rp, Rp, Rp, Rp, Rp, Sp, Sp, Sp, Sp, Sp Sp, Sp, Sp, Sp, Rp, Rp, Rp, Rp, Rp)-d[GsCsCsTsCsAsGsTsCsTsGsCsTsTsCsGsCsAsCsC] | 5R-9S-5R |
| 104 | 106 | (Sp, Sp, Sp, Sp, Sp, Rp, Rp, Rp, Rp, Rp Rp, Rp, Rp, Rp, Sp, Sp, Sp, Sp, Sp)-d[GsCsCsTsCsAsGsTsCsTsGsCsTsTsCsGsCsAsCsC] | 5S-9R-5S |
| 105 | 106 | (Sp, Rp, Rp, Rp, Rp, Rp, Rp, Rp, Rp, Rp Rp, Rp, Rp, Rp, Rp, Rp, Rp, Rp, Sp)-d[GsCsCsTsCsAsGsTsCsTsGsCsTsTsCsGsCsAsCsC] | 1S-17R-1S |
| 106 | 106 | (Rp, Sp, Sp, Sp, Sp, Sp, Sp, Sp, Sp, Sp Sp, Sp, Sp, Sp, Sp, Sp, Sp, Sp, Rp)-d[GsCsCsTsCsAsGsTsCsTsGsCsTsTsCsGsCsAsCsC] | 1R-17S-1R |
| 107 | 106 | (Rp, Sp, Rp, Sp, Rp, Sp, Rp, Sp, Rp, Sp Rp, Sp, Rp, Sp, Rp, Sp, Rp, Sp, Rp)-d[GsCsCsTsCsAsGsTsCsTsGsCsTsTsCsGsCsAsCsC] | (R/S)$_9$R |
| 108 | 106 | (Sp, Rp, Sp, Rp, Sp, Rp, Sp, Rp, Sp, Rp Sp, Rp, Sp, Rp, Sp, Rp, Sp, Rp, Sp)-d[GsCsCsTsCsAsGsTsCsTsGsCsTsTsCsGsCsAsCsC] | (S/R)$_9$S |
| 109 | 106 | (Sp, Sp, Sp, Rp, Rp, Rp, Rp, Rp, Rp, Rp Rp, Rp, Rp, Rp, Rp, Sp, Sp, Sp, Sp) d[GsCsCsTsCsAsGsTsCsTsGsCsTsTsCsGsCsAsCsC] | 3S-13R-3S |
| 110 | 106 | (Rp, Rp, Rp, Sp, Sp, Sp, Sp, Sp, Sp, Sp Sp, Sp, Sp, Sp, Sp, Rp, Rp, Rp, Rp)-d[GsCsCsTsCsAsGsTsCsTsGsCsTsTsCsGsCsAsCsC] | 3R-13S-3R |
| 111 | 106 | (Sp, Sp, Sp, Sp, Sp, Sp, Sp, Sp, Sp, Sp Sp, Sp, Sp, Sp, Sp, Sp, Sp, Sp, Rp)-d[GsCsCsTsCsAsGsTsCsTsGsCsTsTsCsGsCsAsCsC] | 18S/R$^{19}$ |
| 112 | 106 | (Sp, Sp, Sp, Sp, Sp, Sp, Sp, Sp, Sp, Rp Sp, Sp, Sp, Sp, Sp, Sp, Sp, Sp, Sp)-d[GsCsCsTsCsAsGsTsCsTsGsCsTsTsCsGsCsAsCsC] | 18S/R$^9$ |
| 113 | 106 | (Sp, Rp, Sp, Sp, Sp, Sp, Sp, Sp, Sp, Sp Sp, Sp, Sp, Sp, Sp, Sp, Sp, Sp, Sp)-d[GsCsCsTsCsAsGsTsCsTsGsCsTsTsCsGsCsAsCsC] | 18S/R$^2$ |
| 114 | 106 | (Rp, Rp, Sp, Rp, Rp, Sp, Rp, Rp, Sp, Rp Rp, Sp, Rp, Rp, Sp, Rp, Rp, Sp, Rp)-d[GsCsCsTsCsAsGsTsCsTsGsCsTsTsCsGsCsAsCsC] | (RRS)$_6$-R |
| 115 | 106 | (Sp, Rp, Rp, Sp, Rp, Rp, Sp, Rp, Rp, Sp, Rp Rp, Sp, Rp, Rp, Sp, Rp, Rp, Sp)-d[GsCsCsTsCsAsGsTsCsTsGsCsTsTsCsGsCsAsCsC] | S-(RRS)$_6$ |

TABLE 4-continued

Exemplary Mipomersen related sequences.

| Oligo | SEQ ID NO: | Stereochemistry/Sequence | Description |
|---|---|---|---|
| 116 | 106 | (Rp, Sp, Rp, Rp, Sp, Rp, Rp, Sp, Rp Rp, Sp, Rp, Rp, Sp, Rp, Rp, Sp, Rp Rp)d[GsCsCsTsCsAsGsTsCsTsGsCsTsTsCsGsCsAsCsC] | RS-(RRS)$_5$-RR |
| 122 | 106 | All-(Rp)-d[Gs1Cs1Cs1Ts1Cs1As1Gs1Ts1Cs1Ts1Gs1Cs1Ts1Ts1Cs1Gs1Cs1As1Cs1C] | All-R |
| 123 | 106 | (Sp, Rp, Rp, Rp, Rp, Rp, Rp, Rp, Rp, Rp Rp, Rp, Rp, Rp, Rp, Rp, Rp, Sp)-d[Gs1Cs1Cs1Ts1Cs1As1Gs1Ts1Cs1Ts1Gs1Cs1Ts1Ts1Cs1Gs1Cs1As1Cs1C] | 1S-17R-1S |
| 124 | 106 | All-(Sp)-d[Gs1Cs1Cs1Ts1Cs1As1Gs1Ts1Cs1Ts1Gs1Cs1Ts1Ts1Cs1Gs1Cs1As1Cs1C] | All-S |
| 126 | | All-(Rp)-d[Cs2As2Gs2T] | All-R |
| 127 | | All-(Rp)-d[Cs3As3Gs3T] | All-R |
| 128 | | All-(Sp)-d[Cs4As4Gs4T] | All-S |
| 129 | | All-(Sp)-d[Cs5As5Gs5T] | All-S |
| 130 | | All-(Sp)-d[Cs6As6Gs6T] | All-S |
| 131 | 106 | All-(Rp)-d[Gs7Cs7Cs7Ts7Cs7As7Gs7Ts7Cs7Ts7Gs7Cs7Ts7Ts7Cs7Gs7Cs7As7Cs7C] | All-R |
| 132 | 106 | All-(Sp)-d[Gs7Cs7Cs7Ts7Cs7As7Gs7Ts7Cs7Ts7Gs7Cs7Ts7Ts7Cs7Gs7Cs7As7Cs7C] | All-S |
| 133 | 106 | (Rp, Rp, Rp, Rp, Rp, Sp, Sp, Sp, Sp, Sp Sp, Sp, Sp, Sp, Rp, Rp, Rp, Rp, Rp)-d[Gs15mCs15mCs1Ts15mCs1As1Gs1Ts15mCs1Ts1Gs15mCs1Ts1Ts15mCs1Gs15mCs1As15mCs15mC] | 5R-9S-5R |
| 134 | 106 | (Sp, Sp, Sp, Sp, Sp, Rp, Rp, Rp, Rp, Rp Rp, Rp, Rp, Rp, Sp, Sp, Sp, Sp, Sp)-d[Gs15mCs15mCs1Ts15mCs1As1Gs1Ts15mCs1Ts1Gs15mCs1Ts1Ts15mCs1Gs15mCs1As15mCs15mC] | 5S-9R-5S |
| 135 | 108 | All-(Rp)-d[5mCs1As1Gs1Ts15mCs1Ts1Gs15mCs1Ts1Ts15mCs1G] | All-R |
| 136 | 108 | All-(Sp)-d[5mCs1As1Gs1Ts15mCs1Ts1Gs15mCs1Ts1Ts15mCs1G] | All-S |
| 137 | 108 | (Sp, Rp, Rp, Rp, Rp, Rp, Rp, Rp, Rp, Rp, Sp)-d[5mCs1As1Gs1Ts15mCs1Ts1Gs15mCs1Ts1Ts15mCs1G] | 1S-9R-1S |
| 138 | 108 | (Sp, Sp, Rp, Rp, Rp, Rp, Rp, Rp, Rp, Sp, Sp)-d[5mCs1As1Gs1Ts15mCs1Ts1Gs15mCs1Ts1Ts15mCs1G] | 2S-7R-2S |
| 139 | 108 | (Rp, Sp, Sp, Sp, Sp, Sp, Sp, Sp, Sp, Sp, Rp)-d[5mCs1As1Gs1Ts15mCs1Ts1Gs15mCs1Ts1Ts15mCs1G] | 1R-9S-1R |
| 140 | 108 | (Rp, Rp, Sp, Sp, Sp, Sp, Sp, Sp, Sp, Rp, Rp)-d[5mCs1As1Gs1Ts15mCs1Ts1Gs15mCs1Ts1Ts15mCs1G] | 2R-7S-2R |
| 141 | 108 | (Sp, Sp, Sp, Rp, Rp, Rp, Rp, Rp, Sp, Sp, Sp)-d[5mCs1As1Gs1Ts15mCs1Ts1Gs15mCs1Ts1Ts15mCs1G] | 3S-5R-3S |
| 142 | 108 | (Rp, Rp, Rp, Sp, Sp, Sp, Sp, Sp, Rp, Rp, Rp)-d[5mCs1As1Gs1Ts15mCs1Ts1Gs15mCs1Ts1Ts15mCs1G] | 3R-5S-3R |
| 143 | 108 | (Sp, Sp, Rp, Sp, Sp, Rp, Sp, Sp, Rp, Sp, Sp)-d[5mCs1As1Gs1Ts15mCs1Ts1Gs15mCs1Ts1Ts15mCs1G] | (SSR)$_3$-SS |
| 144 | 108 | (Rp, Rp, Sp, Rp, Rp, Sp, Rp, Rp, Sp, Rp, Rp)-d[5mCs1As1Gs1Ts15mCs1Ts1Gs15mCs1Ts1Ts15mCs1G] | (RRS)$_3$-RR |
| 145 | 109 | All-(Rp)-d[5mCs1Ts15mCs1As1Gs1Ts15mCs1Ts1Gs15mCs1Ts1Ts15mCs1Gs15mC] | All-R |
| 146 | | All-(Rp)-d[Gs15mCs1Ts1G] | All-R |
| 147 | | All-(Rp)-d[5mCs1As1Gs1T] | All-R |

TABLE 4-continued

Exemplary Mipomersen related sequences.

| Oligo | SEQ ID NO: | Stereochemistry/Sequence | Description |
|---|---|---|---|
| 148 | 108 | All-(Rp)-d[5mCs2As2Gs2Ts25mCs2Ts2Gs25mCs2Ts2Ts25mCs2G] | All-R |
| 149 | 108 | All-(Rp)-d[5mCs4As4Gs4Ts45mCs4Ts4Gs45mCs4Ts4Ts45mCs4G] | All-R |
| 151 | | All-(Sp)-d[Cs1AsGs1T] | All-S |
| 152 | | All-(Sp)-d[Cs1AGs1T] | All-S |
| 153 | | All-(Sp)-d[CAs1GsT] | All-S |
| 157 | | All-(Sp)-d[5mCs1As1Gs1T] | All-S |
| 158 | 106 | (Sp, Sp, Sp, Sp, Sp, Rp, Rp, Rp, Rp, Rp Rp, Rp, Rp, Rp, Sp, Sp, Sp, Sp)-d[GsCsCsTsCsAsGsTsCsTsGsCsTsTsCs1GsCsAsCsC] | 5S-9R-4S |
| 159 | 106 | (Sp, Sp, Sp, Sp, Sp, Rp, Rp, Rp, Rp, Rp Rp, Rp, Rp, Rp, Sp, Sp, Sp, Sp, Sp)-d[Gs1Cs1Cs1Ts1CsAsGsTsCsTsGsCsTsTsCs1GsCs2As2Cs2C] | 5S-9R-5S |
| 160 | 106 | All-(Rp)-(Gs5mCs5mCsTs5mCs)$_{MOE}$d[AsGsTs5mCsTsGs5mCsTs5mC](Gs5mCsAs5mCs5mC)$_{MOE}$ | All-R |
| 161 | 106 | All-(Sp)-(Gs5mCs5mCsTs5mCs)$_{MOE}$d[AsGsTs5mCsTsGs5mCsTs5mC](Gs5mCsAs5mCs5mC)$_{MOE}$ | All-S |
| 162 | 106 | (Rp, Rp, Rp, Rp, Rp, Sp, Sp, Sp, Sp, Sp Sp, Sp, Sp, Sp, Rp, Rp, Rp, Rp, Rp)-(Gs5mCs5mCsTs5mCs)$_{MOE}$d[AsGsTs5mCsTsGs5mCsTs5mCs](Gs5mCsAs5mCs5mC)$_{MOE}$ | 5R-9S-5R |
| 163 | 106 | (Sp, Sp, Sp, Sp, Sp, Rp, Rp, Rp, Rp, Rp Rp, Rp, Rp, Rp, Sp, Sp, Sp, Sp, Sp)-(Gs5mCs5mCsTs5mCs)$_{MOE}$d[AsGsTs5mCsTsGs5mCsTs5mCs](Gs5mCsAs5mCs5mC)$_{MOE}$ | 5S-9R-5S |
| 164 | 106 | (Sp, Rp, Rp, Rp, Rp, Rp, Rp, Rp, Rp, Rp Rp, Rp, Rp, Rp, Rp, Rp, Rp, Rp, Sp)-(Gs5mCs5mCsTs5mCs)$_{MOE}$d[AsGsTs5mCsTsGs5mCsTs5mCs](Gs5mCsAs5mCs5mC)$_{MOE}$ | 1S-17R-1S |
| 165 | 106 | (Rp, Sp, Sp, Sp, Sp, Sp, Sp, Sp, Sp, Sp Sp, Sp, Sp, Sp, Sp, Sp, Sp, Sp, Rp)-(Gs5mCs5mCsTs5mCs)$_{MOE}$d[AsGsTs5mCsTsGs5mCsTs5mCs](Gs5mCsAs5mCs5mC)$_{MOE}$ | 1R-17S-1R |
| 166 | 106 | (Rp, Sp, Rp, Sp, Rp, Sp, Rp, Sp, Rp, Sp Rp, Sp, Rp, Sp, Rp, Sp, Rp, Sp, Rp)-(Gs5mCs5mCsTs5mCs)$_{MOE}$d[AsGsTs5mCsTsGs5mCsTs5mCs](Gs5mCsAs5mCs5mC)$_{MOE}$ | (R/S)$_9$R |
| 167 | 106 | (Sp, Rp, Sp, Rp, Sp, Rp, Sp, Rp, Sp, Rp Sp, Rp, Sp, Rp, Sp, Rp, Sp, Rp, Sp)-(Gs5mCs5mCsTs5mCs)$_{MOE}$d[AsGsTs5mCsTsGs5mCsTs5mCs](Gs5mCsAs5mCs5mC)$_{MOE}$ | (S/R)$_9$S |
| 168 | 106 | (Sp, Sp, Sp, Rp, Rp, Rp, Rp, Rp, Rp, Rp Rp, Rp, Rp, Rp, Rp, Sp, Sp, Sp, Sp)(Gs5mCs5mCsTs5mCs)$_{MOE}$d[AsGsTs5mCsTsGs5mCsTs5mCs](Gs5mCsAs5mCs5mC)$_{MOE}$ | 3S-13R-3S |
| 169 | 106 | (Rp, Rp, Rp, Sp, Sp, Sp, Sp, Sp, Sp, Sp Sp, Sp, Sp, Sp, Sp, Rp, Rp, Rp)-(Gs5mCs5mCsTs5mCs)$_{MOE}$d[AsGsTs5mCsTsGs5mCsTs5mCs](Gs5mCsAs5mCs5mC)$_{MOE}$ | 3R-13S-3R |
| 170 | 106 | (Sp, Sp, Sp, Sp, Sp, Sp, Sp, Sp, Sp, Sp Sp, Sp, Sp, Sp, Sp, Sp, Sp, Sp, Rp)-(Gs5mCs5mCsTs5mCs)$_{MOE}$d[AsGsTs5mCsTsGs5mCsTs5mCs](Gs5mCsAs5mCs5mC)$_{MOE}$ | 18S/R$^{19}$ |
| 171 | 106 | (Sp, Sp, Sp, Sp, Sp, Sp, Sp, Sp, Rp, Sp Sp, Sp, Sp, Sp, Sp, Sp, Sp, Sp)-(Gs5mCs5mCsTs5mCs)$_{MOE}$d[AsGsTs5mCsTsGs5mCsTs5mCs](Gs5mCsAs5mCs5mC)$_{MOE}$ | 18S/R$^9$ |
| 172 | 106 | (Sp, Rp, Sp, Sp, Sp, Sp, Sp, Sp, Sp, Sp Sp, Sp, Sp, Sp, Sp, Sp, Sp, Sp)-(Gs5mCs5mCsTs5mCs)$_{MOE}$d[AsGsTs5mCsTsGs5mCsTs5mCs](Gs5mCsAs5mCs5mC)$_{MOE}$ | 18S/R$^2$ |
| 173 | 106 | (Rp, Rp, Sp, Rp, Rp, Sp, Rp, Rp, Sp, Rp Rp, Sp, Rp, Rp, Sp, Rp, Rp, Sp, Rp)-(Gs5mCs5mCsTs5mCs)$_{MOE}$d[AsGsTs5mCsTsGs5mCsTs5mCs](Gs5mCsAs5mCs5mC)$_{MOE}$ | (RRS)$_6$-R |

TABLE 4-continued

Exemplary Mipomersen related sequences.

| Oligo | SEQ ID NO: | Stereochemistry/Sequence | Description |
|---|---|---|---|
| 174 | 106 | (Sp, Rp, Rp, Sp, Rp, Rp, Sp, Rp, Rp, Sp, Rp Rp, Sp, Rp, Rp, Sp, Rp, Rp, Sp)-(Gs5mCs5mCsTs5mCs)$_{MOE}$d[AsGsTs5mCsTsGs5mCsTsTs5mCs] (Gs5mCsAs5mCs5mC)$_{MOE}$ | S-(RRS)$_6$ |
| 175 | 106 | (Rp, Sp, Rp, Rp, Sp, Rp, Rp, Sp, Rp Rp, Sp, Rp, Rp, Sp, Rp, Rp, Sp, Rp Rp) (Gs5mCs5mCsTs5mCs)$_{MOE}$d[AsGsTs5mCsTsGs5mCsTsTs5mCs] (Gs5mCsAs5mCs5mC)$_{MOE}$ | RS-(RRS)$_5$-RR |
| 176 | 106 | (Rp, Sp, Rp, Rp, Sp, Rp, Rp, Sp, Rp Rp, Sp, Rp, Rp, Sp, Rp, Rp, Sp, Rp Rp) (Gs15mCs15mCs1Ts15mCs1)$_{MOE}$d[As1Gs1Ts15mCs1Ts1Gs15mCs1Ts1Ts15mCs1] (Gs15mCs1As15mCs15mC)$_{MOE}$ | RS-(RRS)$_5$-RR |
| 177 | 106 | (Rp, Sp, Rp, Rp, Sp, Rp, Rp, Sp, Rp Rp, Sp, Rp, Rp, Sp, Rp, Rp, Sp, Rp Rp) (Gs15mCs15mCs1Ts15mCs1)$_{MOE}$d[AGT5mCTG5mCTT5mC] (Gs25mCs2As25mCs25mC)$_{MOE}$ | RS-(RRS)$_5$-RR |
| 178 | 106 | (Sp, Rp, Rp, Sp, Rp, Rp, Sp, Rp, Rp, Sp, Rp Rp, Sp, Rp, Rp, Sp, Rp, Rp, Sp)-(Gs5mCs5mCsTs5mCs)$_{MOE}$d[AsGsTs5mCsTsGs5mCsTsTs5mCs] (Gs5mCsAs5mCs5mC)$_F$ (F: 2-fluorodeoxyribose) | S-(RRS)$_6$ |
| 179 | 106 | (Rp, Sp, Rp, Rp, Sp, Rp, Rp, Sp, Rp Rp, Sp, Rp, Rp, Sp, Rp, Rp, Sp, Rp Rp)d[Gs8Cs8Cs8Ts8Cs8As8Gs8Ts8Cs8Ts8Gs8Cs8Ts8Cs8Gs8Cs8As8Cs8C] | RS-(RRS)$_5$-RR |
| 180 | 106 | (Rp, Sp, Rp, Rp, Sp, Rp, Rp, Sp, Rp Rp, Sp, Rp, Rp, Sp, Rp, Rp, Sp, Rp Rp)d[Gs9Cs9Cs9Ts9Cs9As9Gs9Ts9Cs9Ts9Gs9Cs9Ts9Cs9Gs9Cs9As9Cs9C] | RS-(RRS)$_5$-RR |
| 181 | 106 | (Rp, Sp, Rp, Rp, Sp, Rp, Rp, Sp, Rp Rp, Sp, Rp, Rp, Sp, Rp, Rp, Sp, Rp Rp)d[Gs10Cs10Cs10Ts10Cs10As10Gs10Ts10Cs10Ts10Gs10Cs10Ts10Cs10Gs10Cs10As10Cs10C] | RS-(RRS)$_5$-RR |
| 182 | 106 | (Rp, Sp, Rp, Rp, Sp, Rp, Rp, Sp, Rp Rp, Sp, Rp, Rp, Sp, Rp, Rp, Sp, Rp Rp)d[Gs11Cs11Cs11Ts11Cs11As11Gs11Ts11Cs11Ts11Gs11Cs11Ts11Cs11Gs11Cs11As11Cs11C] | RS-(RRS)$_5$-RR |
| 183 | 106 | (Rp, Sp, Rp, Rp, Sp, Rp, Rp, Sp, Rp Rp, Sp, Rp, Rp, Sp, Rp, Rp, Sp, Rp Rp)d[Gs12Cs12Cs12Ts12Cs12As12Gs12Ts12Cs12Ts12Gs12Cs12Ts12Cs12Gs12Cs12As12Cs12C] | RS-(RRS)$_5$-RR |
| 184 | 106 | (Rp, Sp, Rp, Rp, Sp, Rp, Rp, Sp, Rp Rp, Sp, Rp, Rp, Sp, Rp, Rp, Sp, Rp Rp)d[Gs13Cs13Cs13Ts13Cs13As13Gs13Ts13Cs13Ts13Gs13Cs13Ts13Cs13Gs13Cs13As13Cs13C] | RS-(RRS)$_5$-RR |
| 185 | 106 | (Rp, Sp, Rp, Rp, Sp, Rp, Rp, Sp, Rp Rp, Sp, Rp, Rp, Sp, Rp, Rp, Sp, Rp Rp)d[Gs14Cs14Cs14Ts14Cs14As14Gs14Ts14Cs14Ts14Gs14Cs14Ts14Cs14Gs14Cs14As14Cs14C] | RS-(RRS)$_5$-RR |
| 186 | 106 | (Rp, Sp, Rp, Rp, Sp, Rp, Rp, Sp, Rp Rp, Sp, Rp, Rp, Sp, Rp, Rp, Sp, Rp Rp)d[Gs15Cs15Cs15Ts15Cs15As15Gs15Ts15Cs15Ts15Gs15Cs15Ts15Cs15Gs15Cs15As15Cs15C] | RS-(RRS)$_5$-RR |
| 187 | 110 | (Rp, Sp, Rp, Rp, Sp, Rp, Rp, Sp, Rp Rp, Sp, Rp, Rp, Sp, Rp, Rp, Sp, Rp Rp)d[GsCsCs1TsCsAs]GsUs2CsUsGsd[CsTs3TsCsGs]CsAs4CsC | RS-(RRS)$_5$-RR |
| 188 | 106 | (Sp, Sp, Sp, Sp, Sp, Rp, Rp, Rp, Rp, Rp Rp, Rp, Rp, Rp, Sp, Sp, Sp, Sp)-d[GsCsCsTsCsAsGsTsCsTsGsCsTsTsCsGsCsACsC] | 5S-9R-4S |
| 189 | 106 | (Sp, Sp, Sp, Sp, Sp, Rp, Rp, Rp, Rp, Rp Rp, Rp, Rp, Rp, Sp, Sp, Sp, Sp)-d[Gs1Cs1Cs1Ts1Cs1As1Gs1Ts1Cs1Ts1Gs1Cs1Ts1Ts1Cs1Gs1CsACs1C] | 5S-9R-4S |
| 190 | 106 | (Sp, Sp, Sp, Sp, Sp, Rp, Rp, Rp, Rp, Rp Rp, Rp, Rp, Rp, Sp, Sp, Sp, Sp)-d[Gs8Cs8Cs8Ts8Cs8As8Gs8Ts8Cs8Ts8Gs8Cs8Ts8Ts8Cs8Gs8Cs1ACs8C] | 5S-9R-4S |
| 191 | 106 | (Sp, Sp, Sp, Sp, Sp, Rp, Rp, Rp, Rp, Rp Rp, Rp, Rp, Rp, Sp, Sp, Sp, Sp)-d[Gs9Cs9Cs9Ts9Cs9As9Gs9Ts9Cs9Ts9Gs9Cs9Ts9Ts9Cs9Gs9Cs1ACs9C] | 5S-9R-4S |
| 192 | 106 | (Sp, Sp, Sp, Sp, Sp, Rp, Rp, Rp, Rp, Rp Rp, Rp, Rp, Rp, Sp, Sp, Sp, Sp)-d[Gs10Cs10Cs10Ts10Cs10As10Gs10Ts10Cs10Ts10Gs10Cs10Ts10Ts10Cs10Gs10Cs1ACs10C] | 5S-9R-4S |

TABLE 4-continued

Exemplary Mipomersen related sequences.

| Oligo | SEQ ID NO: | Stereochemistry/Sequence | Description |
|---|---|---|---|
| 193 | 106 | (Sp, Sp, Sp, Sp, Sp, Rp, Rp, Rp, Rp, Rp Rp, Rp, Rp, Rp, Sp, Sp, Sp, Sp)-d[Gs11Cs11Cs11Ts11Cs11As11Gs11Ts11Cs11Ts11Gs11Cs11Ts11Ts11Cs11Gs11Cs1ACs11C] | 5S-9R-4S |
| 194 | 106 | (Sp, Sp, Sp, Sp, Sp, Rp, Rp, Rp, Rp, Rp Rp, Rp, Rp, Rp, Sp, Sp, Sp, Sp)-d[Gs12Cs12Cs12Ts12Cs12As12Gs12Ts12Cs12Ts12Gs12Cs12Ts12Ts12Cs12Gs12Cs1ACs12C] | 5S-9R-4S |
| 195 | 106 | (Sp, Sp, Sp, Sp, Sp, Rp, Rp, Rp, Rp, Rp Rp, Rp, Rp, Rp, Sp, Sp, Sp, Sp)-d[Gs13Cs13Cs13Ts13Cs13As13Gs13Ts13Cs13Ts13Gs13Cs13Ts13Ts13Cs13Gs13Cs1ACs13C] | 5S-9R-4S |
| 196 | 106 | (Sp, Sp, Sp, Sp, Sp, Rp, Rp, Rp, Rp, Rp Rp, Rp, Rp, Rp, Sp, Sp, Sp, Sp)-d[Gs14Cs14Cs14Ts14Cs14As14Gs14Ts14Cs14Ts14Gs14Cs14Ts14Ts14Cs14Gs14Cs1ACs14C] | 5S-9R-4S |
| 197 | 106 | (Sp, Sp, Sp, Sp, Sp, Rp, Rp, Rp, Rp, Rp Rp, Rp, Rp, Rp, Sp, Sp, Sp, Sp)-d[Gs15Cs15Cs15Ts15Cs15As15Gs15Ts15Cs15Ts15Gs15Cs15Ts15Ts15Cs15Gs15Cs1ACs15C] | 5S-9R-4S |
| 198 | 111 | (Sp, Sp, Sp, Sp, Sp, Rp, Rp, Rp, Rp, Rp Rp, Rp, Rp, Rp, Sp, Sp, Sp, Sp)-GsCsCsUsCsAsGsUsCsUsGsCsUsUsCsGsCsACsC | 5S-9R-4S |
| 199 | 111 | (Sp, Sp, Sp, Sp, Sp, Rp, Rp, Rp, Rp, Rp Rp, Rp, Rp, Rp, Sp, Sp, Sp, Sp)-Gs1Cs1Cs1Us1Cs1As1Gs1Us1Cs1Us1Gs1Cs1Us1Us1Cs1Gs1CsACs1C | 5S-9R-4S |
| 200 | 111 | (Sp, Sp, Sp, Sp, Sp, Rp, Rp, Rp, Rp, Rp Rp, Rp, Rp, Rp, Sp, Sp, Sp, Sp)-Gs8Cs8Cs8Us8Cs8As8Gs8Us8Cs8Us8Gs8Cs8Us8Us8Cs8Gs8Cs1ACs8C | 5S-9R-4S |
| 201 | 111 | (Sp, Sp, Sp, Sp, Sp, Rp, Rp, Rp, Rp, Rp Rp, Rp, Rp, Rp, Sp, Sp, Sp, Sp)-Gs9Cs9Cs9Us9Cs9As9Gs9Us9Cs9Us9Gs9Cs9Us9Us9Cs9Gs9Cs1ACs9C | 5S-9R-4S |
| 202 | 111 | (Sp, Sp, Sp, Sp, Sp, Rp, Rp, Rp, Rp, Rp Rp, Rp, Rp, Rp, Sp, Sp, Sp, Sp)-Gs10Cs10Cs10Us10Cs10As10Gs10Us10Cs10Us10Gs10Cs10Us10Us10Cs10Gs10Cs1ACs10C | 5S-9R-4S |
| 203 | 111 | (Sp, Sp, Sp, Sp, Sp, Rp, Rp, Rp, Rp, Rp Rp, Rp, Rp, Rp, Sp, Sp, Sp, Sp)-Gs11Cs11Cs11Us11Cs11As11Gs11Us11Cs11Us11Gs11Cs11Us11Us11Cs11Gs11Cs1ACs11C | 5S-9R-4S |
| 204 | 111 | (Sp, Sp, Sp, Sp, Sp, Rp, Rp, Rp, Rp, Rp Rp, Rp, Rp, Rp, Sp, Sp, Sp, Sp)-Gs12Cs12Cs12Us12Cs12As12Gs12Us12Cs12Us12Gs12Cs12Us12Us12Cs12Gs12Cs1ACs12C | 5S-9R-4S |
| 205 | 111 | (Sp, Sp, Sp, Sp, Sp, Rp, Rp, Rp, Rp, Rp Rp, Rp, Rp, Rp, Sp, Sp, Sp, Sp)-Gs13Cs13Cs13Us13Cs13As13Gs13Us13Cs13Us13Gs13Cs13Us13Us13Cs13Gs13Cs1ACs13C | 5S-9R-4S |
| 206 | 111 | (Sp, Sp, Sp, Sp, Sp, Rp, Rp, Rp, Rp, Rp Rp, Rp, Rp, Rp, Sp, Sp, Sp, Sp)-Gs14Cs14Cs14Us14Cs14As14Gs14Us14Cs14Us14Gs14Cs14Us14Us14Cs14Gs14Cs1ACs14C | 5S-9R-4S |
| 207 | 111 | (Sp, Sp, Sp, Sp, Sp, Rp, Rp, Rp, Rp, Rp Rp, Rp, Rp, Rp, Sp, Sp, Sp, Sp)-Gs15Cs15Cs15Us15Cs15As15Gs15Us15Cs15Us15Gs15Cs15Us15Us15Cs15Gs15Cs1ACs15C | 5S-9R-4S |

Oligonucleotide Compositions

The present invention provides compositions comprising or consisting of a plurality of provided oligonucleotides (e.g., chirally controlled oligonucleotide compositions). In some embodiments, all such provided oligonucleotides are of the same type, i.e., all have the same base sequence, pattern of backbone linkages (i.e., pattern of internucleotidic linkage types, for example, phosphate, phosphorothioate, etc), pattern of backbone chiral centers (i.e. pattern of linkage phosphorus stereochemistry (Rp/Sp)), and pattern of backbone phosphorus modifications (e.g., pattern of "—XLR$^1$" groups in formula I). In many embodiments, however, provided compositions comprise a plurality of oligonucleotides types, typically in pre-determined relative amounts.

In some embodiments, a provided chirally controlled oligonucleotide composition is a chirally pure mipomersen composition. That is to say, in some embodiments, a provided chirally controlled oligonucleotide composition provides mipomersen as a single diastereomer with respect to the configuration of the linkage phosphorus.

In some embodiments, a provided chirally controlled oligonucleotide composition is a chirally uniform mipomersen composition. That is to say, in some embodiments, every linkage phosphorus of mipomersen is in the Rp configuration or every linkage phosphorus of mipomersen is in the Sp configuration.

In some embodiments, a provided chirally controlled oligonucleotide composition comprises a combination of one or more provided oligonucleotide types. One of skill in the chemical and medicinal arts will recognize that the selection and amount of each of the one or more types of provided oligonucleotides in a provided composition will depend on the intended use of that composition. That is to say, one of skill in the relevant arts would design a provided chirally controlled oligonucleotide composition such that the amounts and types of provided oligonucleotides contained therein cause the composition as a whole to have certain desirable characteristics (e.g., biologically desirable, therapeutically desirable, etc.).

In some embodiments, a provided chirally controlled oligonucleotide composition comprises a combination of two or more provided oligonucleotide types. In some embodiments, a provided chirally controlled oligonucleotide composition comprises a combination of three or more provided oligonucleotide types. In some embodiments, a provided chirally controlled oligonucleotide composition comprises a combination of four or more provided oligonucleotide types. In some embodiments, a provided chirally controlled oligonucleotide composition comprises a combination of five or more provided oligonucleotide types. In some embodiments, a provided chirally controlled oligonucleotide composition comprises a combination of six or more provided oligonucleotide types. In some embodiments, a provided chirally controlled oligonucleotide composition comprises a combination of seven or more provided oligonucleotide types. In some embodiments, a provided chirally controlled oligonucleotide composition comprises a combination of eight or more provided oligonucleotide types. In some embodiments, a provided chirally controlled oligonucleotide composition comprises a combination of nine or more provided oligonucleotide types. In some embodiments, a provided chirally controlled oligonucleotide composition comprises a combination of ten or more provided oligonucleotide types. In some embodiments, a provided chirally controlled oligonucleotide composition comprises a combination of fifteen or more provided oligonucleotide types.

In some embodiments, a provided chirally controlled oligonucleotide composition is a combination of an amount of chirally uniform mipomersen of the Rp configuration and an amount of chirally uniform mipomersen of the Sp configuration.

In some embodiments, a provided chirally controlled oligonucleotide composition is a combination of an amount of chirally uniform mipomersen of the Rp configuration, an amount of chirally uniform mipomersen of the Sp configuration, and an amount of one or more chirally pure mipomersen of a desired diastereomeric form.

Methods for Making Chirally Controlled Oligonucleotides and Compositions Thereof The present invention provides methods for making chirally controlled oligonucleotides and chirally controlled compositions comprising one or more specific nucleotide types. As noted above, the phrase "oligonucleotide type," as used herein, defines an oligonucleotide that has a particular base sequence, pattern of backbone linkages, pattern of backbone chiral centers, and pattern of backbone phosphorus modifications (e.g., "—XLR" groups). Oligonucleotides of a common designated "type" are structurally identical to one another with respect to base sequence, pattern of backbone linkages, pattern of backbone chiral centers, and pattern of backbone phosphorus modifications.

In some embodiments, a provided chirally controlled oligonucleotide in the invention has properties different from those of the corresponding stereorandom oligonucleotide mixture. In some embodiments, a chirally controlled oligonucleotide has lipophilicity different from that of the stereorandom oligonucleotide mixture. In some embodiments, a chirally controlled oligonucleotide has different retention time on HPLC. In some embodiments, a chirally controlled oligonucleotide may have a peak retention time significantly different from that of the corresponding stereorandom oligonucleotide mixture. During oligonucleotide purification using HPLC as generally practiced in the art, certain chirally controlled oligonucleotides will be largely if not totally lost. During oligonucleotide purification using HPLC as generally practiced in the art, certain chirally controlled oligonucleotides will be largely if not totally lost. One of the consequences is that certain diastereomers of a stereorandom oligonucleotide mixture (certain chirally controlled oligonucleotides) are not tested in assays. Another consequence is that from batches to batches, due to the inevitable instrumental and human errors, the supposedly "pure" stereorandom oligonucleotide will have inconsistent compositions in that diastereomers in the composition, and their relative and absolute amounts, are different from batches to batches. The chirally controlled oligonucleotide and chirally controlled oligonucleotide composition provided in this invention overcome such problems, as a chirally controlled oligonucleotide is synthesized in a chirally controlled fashion as a single diastereomer, and a chirally controlled oligonucleotide composition comprise predetermined levels of one or more individual oligonucleotide types.

One of skill in the chemical and synthetic arts will appreciate that synthetic methods of the present invention provide for a degree of control during each step of the synthesis of a provided oligonucleotide such that each nucleotide unit of the oligonucleotide can be designed and/or selected in advance to have a particular stereochemistry at the linkage phosphorus and/or a particular modification at the linkage phosphorus, and/or a particular base, and/or a particular sugar. In some embodiments, a provided oligonucleotide is designed and/or selected in advance to have a particular combination of stereocenters at the linkage phosphorus of the internucleotidic linkage.

In some embodiments, a provided oligonucleotide made using methods of the present invention is designed and/or determined to have a particular combination of linkage phosphorus modifications. In some embodiments, a provided oligonucleotide made using methods of the present invention is designed and/or determined to have a particular combination of bases. In some embodiments, a provided oligonucleotide made using methods of the present invention is designed and/or determined to have a particular combination of sugars. In some embodiments, a provided oligonucleotide made using methods of the present invention is designed and/or determined to have a particular combination of one or more of the above structural characteristics.

Methods of the present invention exhibit a high degree of chiral control. For instance, methods of the present invention facilitate control of the stereochemical configuration of every single linkage phosphorus within a provided oligonucleotide. In some embodiments, methods of the present invention provide an oligonucleotide comprising one or more modified internucleotidic linkages independently having the structure of formula I.

In some embodiments, methods of the present invention provide an oligonucleotide which is a mipomersen unimer. In some embodiments, methods of the present invention provide an oligonucleotide which is a mipomersen unimer of configuration Rp. In some embodiments, methods of the present invention provide an oligonucleotide which is a mipomersen unimer of configuration Sp.

In some embodiments, methods of the present invention provide a chirally controlled oligonucleotide composition, i.e., an oligonucleotide composition that contains predetermined levels of individual oligonucleotide types. In some embodiments a chirally controlled oligonucleotide composition comprises one oligonucleotide type. In some embodiments, a chirally controlled oligonucleotide composition comprises more than one oligonucleotide type. In some embodiments, a chirally controlled oligonucleotide composition comprises a plurality of oligonucleotide types. Exemplary chirally controlled oligonucleotide compositions made in accordance with the present invention are described herein.

In some embodiments, methods of the present invention provide chirally pure mipomersen compositions with respect to the configuration of the linkage phosphorus. That is to say, in some embodiments, methods of the present invention provide compositions of mipomersen wherein mipomersen exists in the composition in the form of a single diastereomer with respect to the configuration of the linkage phosphorus.

In some embodiments, methods of the present invention provide chirally uniform mipomersen compositions with respect to the configuration of the linkage phosphorus. That is to say, in some embodiments, methods of the present invention provide compositions of mipomersen in which all nucleotide units therein have the same stereochemistry with respect to the configuration of the linkage phosphorus, e.g., all nucleotide units are of the Rp configuration at the linkage phosphorus or all nucleotide units are of the Sp configuration at the linkage phosphorus.

In some embodiments, a provided chirally controlled oligonucleotide is over 50% pure. In some embodiments, a provided chirally controlled oligonucleotide is over about 55% pure. In some embodiments, a provided chirally controlled oligonucleotide is over about 60% pure. In some embodiments, a provided chirally controlled oligonucleotide is over about 65% pure. In some embodiments, a provided chirally controlled oligonucleotide is over about 70% pure. In some embodiments, a provided chirally controlled oligonucleotide is over about 75% pure. In some embodiments, a provided chirally controlled oligonucleotide is over about 80% pure. In some embodiments, a provided chirally controlled oligonucleotide is over about 85% pure. In some embodiments, a provided chirally controlled oligonucleotide is over about 90% pure. In some embodiments, a provided chirally controlled oligonucleotide is over about 91% pure. In some embodiments, a provided chirally controlled oligonucleotide is over about 92% pure. In some embodiments, a provided chirally controlled oligonucleotide is over about 93% pure. In some embodiments, a provided chirally controlled oligonucleotide is over about 94% pure. In some embodiments, a provided chirally controlled oligonucleotide is over about 95% pure. In some embodiments, a provided chirally controlled oligonucleotide is over about 96% pure. In some embodiments, a provided chirally controlled oligonucleotide is over about 97% pure. In some embodiments, a provided chirally controlled oligonucleotide is over about 98% pure. In some embodiments, a provided chirally controlled oligonucleotide is over about 99% pure. In some embodiments, a provided chirally controlled oligonucleotide is over about 99.5% pure. In some embodiments, a provided chirally controlled oligonucleotide is over about 99.6% pure. In some embodiments, a provided chirally controlled oligonucleotide is over about 99.7% pure. In some embodiments, a provided chirally controlled oligonucleotide is over about 99.8% pure. In some embodiments, a provided chirally controlled oligonucleotide is over about 99.9% pure. In some embodiments, a provided chirally controlled oligonucleotide is over at least about 99% pure.

In some embodiments, a chirally controlled oligonucleotide composition is a composition designed to comprise a single oligonucleotide type. In certain embodiments, such compositions are about 50% diastereomerically pure. In some embodiments, such compositions are about 50% diastereomerically pure. In some embodiments, such compositions are about 50% diastereomerically pure. In some embodiments, such compositions are about 55% diastereomerically pure. In some embodiments, such compositions are about 60% diastereomerically pure. In some embodiments, such compositions are about 65% diastereomerically pure. In some embodiments, such compositions are about 70% diastereomerically pure. In some embodiments, such compositions are about 75% diastereomerically pure. In some embodiments, such compositions are about 80% diastereomerically pure. In some embodiments, such compositions are about 85% diastereomerically pure. In some embodiments, such compositions are about 90% diastereomerically pure. In some embodiments, such compositions are about 91% diastereomerically pure. In some embodiments, such compositions are about 92% diastereomerically pure. In some embodiments, such compositions are about 93% diastereomerically pure. In some embodiments, such compositions are about 94% diastereomerically pure. In some embodiments, such compositions are about 95% diastereomerically pure. In some embodiments, such compositions are about 96% diastereomerically pure. In some embodiments, such compositions are about 97% diastereomerically pure. In some embodiments, such compositions are about 98% diastereomerically pure. In some embodiments, such compositions are about 99% diastereomerically pure. In some embodiments, such compositions are about 99.5% diastereomerically pure. In some embodiments, such compositions are about 99.6% diastereomerically pure. In some embodiments, such compositions are about 99.7% diastereomerically pure. In some embodiments, such compositions are about 99.8% diastereomerically pure. In some embodiments, such compositions are about 99.9% diastereomerically pure. In some embodiments, such compositions are at least about 99% diastereomerically pure.

In some embodiments, a chirally controlled oligonucleotide composition is a composition designed to comprise multiple oligonucleotide types. In some embodiments, methods of the present invention allow for the generation of a library of chirally controlled oligonucleotides such that a pre-selected amount of any one or more chirally controlled oligonucleotide types can be mixed with any one or more other chirally controlled oligonucleotide types to create a chirally controlled oligonucleotide composition. In some embodiments, the pre-selected amount of an oligonucleotide type is a composition having any one of the above-described diastereomeric purities.

In some embodiments, the present invention provides methods for making a chirally controlled oligonucleotide comprising steps of:

(1) coupling;

(2) capping;

(3) modifying;

(4) deblocking; and (5) repeating steps (1)-(4) until a desired length is achieved.

When describing the provided methods, the word "cycle" has its ordinary meaning as understood by a person of ordinary skill in the art. In some embodiments, one round of steps (1)-(4) is referred to as a cycle.

In some embodiments, the present invention provides methods for making chirally controlled oligonucleotide compositions, comprising steps of:

(a) providing an amount of a first chirally controlled oligonucleotide; and (b) optionally providing an amount of one or more additional chirally controlled oligonucleotides.

In some embodiments, a first chirally controlled oligonucleotide is an oligonucleotide type, as described herein. In some embodiments, a one or more additional chirally controlled oligonucleotide is a one or more oligonucleotide type, as described herein.

One of skill in the relevant chemical and synthetic arts will recognize the degree of versatility and control over structural variation and stereochemical configuration of a provided oligonucleotide when synthesized using methods of the present invention. For instance, after a first cycle is complete, a subsequent cycle can be performed using a nucleotide unit individually selected for that subsequent cycle which, in some embodiments, comprises a nucleobase and/or a sugar that is different from the first cycle nucleobase and/or sugar. Likewise, the chiral auxiliary used in the coupling step of the subsequent cycle can be different from the chiral auxiliary used in the first cycle, such that the second cycle generates a phosphorus linkage of a different stereochemical configuration. In some embodiments, the stereochemistry of the linkage phosphorus in the newly formed internucleotidic linkage is controlled by using stereochemically pure phosphoramidites. Additionally, the modification reagent used in the modifying step of a subsequent cycle can be different from the modification reagent used in the first or former cycle. The cumulative effect of this iterative assembly approach is such that each component of a provided oligonucleotide can be structurally and configurationally tailored to a high degree. An additional advantage to this approach is that the step of capping minimizes the formation of "n-1" impurities that would otherwise make isolation of a provided oligonucleotide extremely challenging, and especially oligonucleotides of longer lengths.

In some embodiments, an exemplary cycle of the method for making chirally controlled oligonucleotides is illustrated in Scheme I. In Scheme I,

represents the solid support, and optionally a portion of the growing chirally controlled oligonucleotide attached to the solid support. The chiral auxiliary exemplified has the structure of formula 3-I:

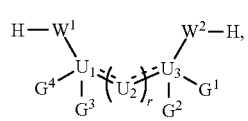

Formula 3-I which is further described below. "Cap" is any chemical moiety introduced to the nitrogen atom by the capping step, and in some embodiments, is an amino protecting group. One of ordinary skill in the art understands that in the first cycle, there may be only one nucleoside attached to the solid support when started, and cycle exit can be performed optionally before deblocking. As understood by a person of skill in the art, $B^{PRO}$ is a protected base used in oligonucleotide synthesis. Each step of the above-depicted cycle of Scheme I is described further below.

Scheme I. Synthesis of chirally controlled oligonucleotide.

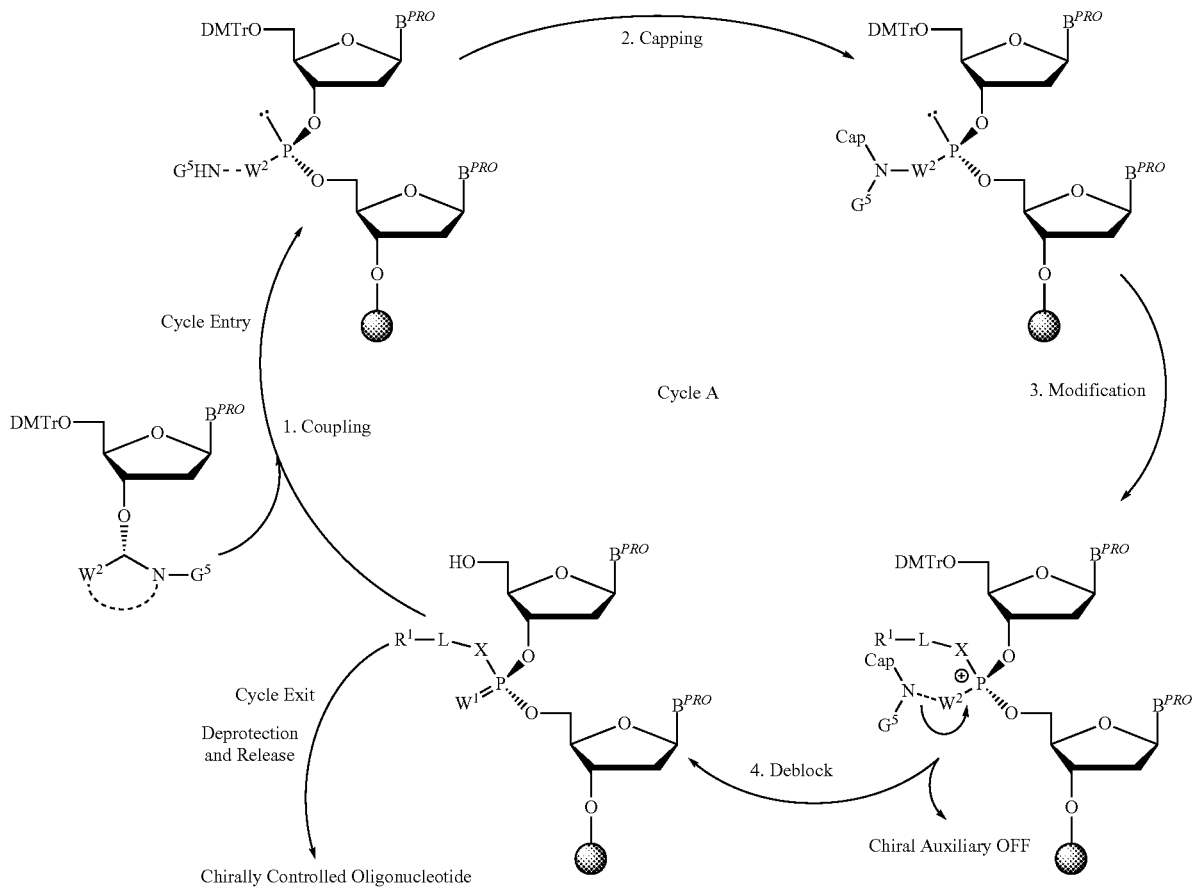

Synthesis on Solid Support

In some embodiments, the synthesis of a provided oligonucleotide is performed on solid phase. In some embodiments, reactive groups present on a solid support are protected. In some embodiments, reactive groups present on a solid support are unprotected. During oligonucleotide synthesis a solid support is treated with various reagents in several synthesis cycles to achieve the stepwise elongation of a growing oligonucleotide chain with individual nucleotide units. The nucleoside unit at the end of the chain which is directly linked to the solid support is termed "the first nucleoside" as used herein. A first nucleoside is bound to a solid support via a linker moiety, i.e. a diradical with covalent bonds between either of a CPG, a polymer or other solid support and a nucleoside. The linker stays intact during the synthesis cycles performed to assemble the oligonucleotide chain and is cleaved after the chain assembly to liberate the oligonucleotide from the support.

Solid supports for solid-phase nucleic acid synthesis include the supports described in, e.g., U.S. Pat. Nos. 4,659,774, 5,141,813, 4,458,066; Caruthers U.S. Pat. Nos. 4,415,732, 4,458,066, 4,500,707, 4,668,777, 4,973,679, and 5,132,418; Andrus et al. U.S. Pat. Nos. 5,047,524, 5,262,530; and Koster U.S. Pat. No. 4,725,677 (reissued as Re34,069). In some embodiments, a solid phase is an organic polymer support. In some embodiments, a solid phase is an inorganic polymer support. In some embodiments, an organic polymer support is polystyrene, aminomethyl polystyrene, a polyethylene glycol-polystyrene graft copolymer, polyacrylamide, polymethacrylate, polyvinylalcohol, highly cross-linked polymer (HCP), or other synthetic polymers, carbohydrates such as cellulose and starch or other polymeric carbohydrates, or other organic polymers and any copolymers, composite materials or combination of the above inorganic or organic materials. In some embodiments, an inorganic polymer support is silica, alumina, controlled polyglass (CPG), which is a silica-gel support, or aminopropyl CPG. Other useful solid supports include fluorous solid supports (see e.g., WO/2005/070859), long chain alkylamine (LCAA) controlled pore glass (CPG) solid supports (see e.g., S. P. Adams, K. S. Kavka, E. J. Wykes, S. B. Holder and G. R. Galluppi, *J. Am. Chem. Soc.*, 1983, 105, 661-663; G. R. Gough, M. J. Bruden and P. T. Gilham, *Tetrahedron Lett.*, 1981, 22, 4177-4180). Membrane supports and polymeric membranes (see e.g. Innovation and Perspectives in Solid Phase Synthesis, Peptides, Proteins and Nucleic Acids, ch 21 pp 157-162, 1994, Ed. Roger Epton and U.S. Pat. No. 4,923,901) are also useful for the synthesis of nucleic acids. Once formed, a membrane can be chemically functionalized for use in nucleic acid synthesis. In addition to the attachment of a functional group to the membrane, the use of a linker or spacer group attached to the membrane is also used in some embodiments to minimize steric hindrance between the membrane and the synthesized chain.

Other suitable solid supports include those generally known in the art to be suitable for use in solid phase methodologies, including, for example, glass sold as Primer™ 200 support, controlled pore glass (CPG), oxalyl-controlled pore glass (see, e.g., Alul, et al., *Nucleic Acids Research*, 1991, 19, 1527), TentaGel Support—an aminopolyethyleneglycol derivatized support (see, e.g., Wright, et al., *Tetrahedron Lett.*, 1993, 34, 3373), and Poros—a copolymer of polystyrene/divinylbenzene.

Surface activated polymers have been demonstrated for use in synthesis of natural and modified nucleic acids and proteins on several solid supports mediums. A solid support material can be any polymer suitably uniform in porosity, having sufficient amine content, and sufficient flexibility to undergo any attendant manipulations without losing integrity. Examples of suitable selected materials include nylon, polypropylene, polyester, polytetrafluoroethylene, polystyrene, polycarbonate, and nitrocellulose. Other materials can serve as a solid support, depending on the design of the investigator. In consideration of some designs, for example, a coated metal, in particular gold or platinum can be selected (see e.g., US publication No. 20010055761). In one embodiment of oligonucleotide synthesis, for example, a nucleoside is anchored to a solid support which is functionalized with hydroxyl or amino residues. Alternatively, a solid support is derivatized to provide an acid labile trialkoxytrityl group, such as a trimethoxytrityl group (TMT). Without being bound by theory, it is expected that the presence of a trialkoxytrityl protecting group will permit initial detritylation under conditions commonly used on DNA synthesizers. For a faster release of oligonucleotide material in solution with aqueous ammonia, a diglycoate linker is optionally introduced onto the support.

In some embodiments, a provided oligonucleotide alternatively is synthesized from the 5' to 3' direction. In some embodiments, a nucleic acid is attached to a solid support through its 5' end of the growing nucleic acid, thereby presenting its 3' group for reaction, i.e. using 5'-nucleoside phosphoramidites or in enzymatic reaction (e.g. ligation and polymerization using nucleoside 5'-triphosphates). When considering the 5' to 3' synthesis the iterative steps of the present invention remain unchanged (i.e. capping and modification on the chiral phosphorus).

Linking Moiety

A linking moiety or linker is optionally used to connect a solid support to a compound comprising a free nucleophilic moiety. Suitable linkers are known such as short molecules which serve to connect a solid support to functional groups (e.g., hydroxyl groups) of initial nucleosides molecules in solid phase synthetic techniques. In some embodiments, the linking moiety is a succinamic acid linker, or a succinate linker (—CO—CH$_2$—CH$_2$—CO—), or an oxalyl linker (—CO—CO—). In some embodiments, the linking moiety and the nucleoside are bonded together through an ester bond. In some embodiments, a linking moiety and a nucleoside are bonded together through an amide bond. In some embodiments, a linking moiety connects a nucleoside to another nucleotide or nucleic acid. Suitable linkers are disclosed in, for example, *Oligonucleotides And Analogues A Practical Approach*, Ekstein, F. Ed., IRL Press, N.Y., 1991, Chapter 1 and Solid-Phase Supports for Oligonucleotide Synthesis, Pon, R. T., *Curr. Prot. Nucleic Acid Chem.*, 2000, 3.1.1-3.1.28.

A linker moiety is used to connect a compound comprising a free nucleophilic moiety to another nucleoside, nucleotide, or nucleic acid. In some embodiments, a linking moiety is a phosphodiester linkage. In some embodiments, a linking moiety is an H-phosphonate moiety. In some embodiments, a linking moiety is a modified phosphorus linkage as described herein. In some embodiments, a universal linker (UnyLinker) is used to attached the oligonucleotide to the solid support (Ravikumar et al., *Org. Process Res. Dev.*, 2008, 12 (3), 399-410). In some embodiments, other universal linkers are used (Pon, R. T., *Curr. Prot. Nucleic Acid Chem.*, 2000, 3.1.1-3.1.28). In some embodiments, various orthogonal linkers (such as disulfide linkers) are used (Pon, R. T., *Curr. Prot. Nucleic Acid Chem.*, 2000, 3.1.1-3.1.28).

General Conditions—Solvents for Synthesis

Syntheses of provided oligonucleotides are generally performed in aprotic organic solvents. In some embodiments, a solvent is a nitrile solvent such as, e.g., acetonitrile. In some embodiments, a solvent is a basic amine solvent such as, e.g., pyridine. In some embodiments, a solvent is an ethereal solvent such as, e.g., tetrahydrofuran. In some embodiments, a solvent is a halogenated hydrocarbon such as, e.g., dichloromethane. In some embodiments, a mixture of solvents is used. In certain embodiments a solvent is a mixture of any one or more of the above-described classes of solvents.

In some embodiments, when an aprotic organic solvent is not basic, a base is present in the reacting step. In some embodiments where a base is present, the base is an amine base such as, e.g., pyridine, quinoline, or N,N-dimethylaniline. Exemplary other amine bases include pyrrolidine, piperidine, N-methyl pyrrolidine, pyridine, quinoline, N,N-dimethylaminopyridine (DMAP), or N,N-dimethylaniline.

In some embodiments, a base is other than an amine base.

In some embodiments, an aprotic organic solvent is anhydrous. In some embodiments, an anhydrous aprotic organic solvent is freshly distilled. In some embodiments, a freshly distilled anhydrous aprotic organic solvent is a basic amine solvent such as, e.g., pyridine. In some embodiments, a freshly distilled anhydrous aprotic organic solvent is an ethereal solvent such as, e.g., tetrahydrofuran. In some embodiments, a freshly distilled anhydrous aprotic organic solvent is a nitrile solvent such as, e.g., acetonitrile.

Chiral Reagent

In provided methods, chiral reagents are used to confer stereoselectivity in the production of chirally controlled oligonucleotides. Many different chiral reagents, also referred to by those of skill in the art and herein as chiral auxiliaries, may be used in accordance with methods of the present invention. Exemplary such chiral reagents are described herein and in Wada I, II and III, referenced above. In certain embodiments, a chiral reagent is as described by Wada I. In some embodiments, a chiral reagent for use in accordance with the methods of the present invention are of Formula 3-I, below:

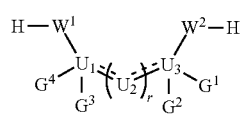

Formula 3-I wherein $W^1$ and $W^2$ are any of —O—, —S—, or —NG$^5$-, $U_1$ and $U_3$ are carbon atoms which are bonded to $U_2$ if present, or to each other if r is 0, via a single, double or triple bond. $U_2$ is —C—, —CG$^8$—, —CG$^8$G$^8$—, —NG$^8$-, —N—, —O—, or —S— where r is an integer of 0 to 5 and no more than two heteroatoms are adjacent. When any one of $U_2$ is C, a triple bond must be formed between a second instance of $U_2$, which is C, or to one of $U_1$ or $U_3$. Similarly, when any one of $U_2$ is CG$^8$, a double bond is formed between a second instance of $U_2$ which is —CG$^8$- or —N—, or to one of $U_1$ or $U_3$.

In some embodiments, —U$_1$—(U$_2$)$_r$—U$_3$— is —CG$^3$G$^4$-CG$^1$G$^2$-. In some embodiments, —U$_1$—(U$_2$)$_r$—U$_3$— is —CG$^3$=CG$^1$-. In some embodiments, —U$_1$—(U$_2$)$_r$—U$_3$— is —C≡C—. In some embodiments, —U$_1$—(U$_2$)$_r$—U$_3$— is —CG$^3$=CG$^8$-CG$^1$G$^2$-. In some embodiments, —U$_1$—(U$_2$)$_r$—U— is —CG$^3$G$^4$-O—CG$^1$G$^2$-. In some embodiments, —U$_1$—(U$_2$)$_r$—U$_3$— is —CG$^3$G$^4$-NG$^8$—CG$^1$G$^2$-. In some embodiments, —U$_1$—(U$_2$)$_r$—U$_3$— is —CG$^3$G$^4$-N—CG$^2$-. In some embodiments, —U$_1$—(U$_2$)$_r$—U$_3$— is —CG$^3$G$^4$-N=C G$^8$-CG$^1$G$^2$-.

As defined herein, G$^1$, G$^2$, G$^3$, G$^4$, G$^5$, and G$^8$ are independently hydrogen, or an optionally substituted group selected from alkyl, aralkyl, cycloalkyl, cycloalkylalkyl, heterocyclyl, heteroaryl, and aryl; or two of G$^1$, G$^2$, G$^3$, G$^4$, and G$^5$ are G$^6$ taken together to form an optionally substituted, saturated, partially unsaturated or unsaturated carbocyclic or heteroatom-containing ring of up to about 20 ring atoms which is monocyclic or polycyclic, and is fused or unfused. In some embodiments, a ring so formed is substituted by oxo, thioxo, alkyl, alkenyl, alkynyl, heteroaryl, or aryl moieties. In some embodiments, when a ring formed by taking two G$^6$ together is substituted, it is substituted by a moiety which is bulky enough to confer stereoselectivity during the reaction.

In some embodiments, a ring formed by taking two of G$^6$ together is optionally substituted cyclopentyl, pyrrolyl, cyclopropyl, cyclohexenyl, cyclopentenyl, tetrahydropyranyl, or piperazinyl. In some embodiments, a ring formed by taking two of G$^6$ together is optionally substituted cyclopentyl, pyrrolyl, cyclopropyl, cyclohexenyl, cyclopentenyl, tetrahydropyranyl, pyrrolidinyl, or piperazinyl.

In some embodiments, G$^1$ is optionally substituted phenyl. In some embodiments, G$^1$ is phenyl. In some embodiments, G$^2$ is methyl or hydrogen. In some embodiments, G$^1$ is optionally substituted phenyl and G$^2$ is methyl. In some embodiments, G$^1$ is phenyl and G$^2$ is methyl.

In some embodiments, r is 0.

In some embodiments, W$^1$ is —NG$^5$-. In some embodiments, one of G$^3$ and G$^4$ is taken together with G$^5$ to form an optionally substituted pyrrolidinyl ring. In some embodiments, one of G$^3$ and G$^4$ is taken together with G$^5$ to form a pyrrolidinyl ring.

In some embodiments, W$^2$ is —O—.

In some embodiments, a chiral reagent is a compound of Formula 3-AA:

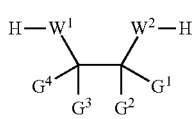

Formula 3-AA wherein each variable is independently as defined above and described herein.

In some embodiments of Formula 3AA, W$^1$ and W$^2$ are independently —NG$^5$-, —O—, or —S—; G$^1$, G$^2$, G$^3$, G$^4$, and G$^5$ are independently hydrogen, or an optionally substituted group selected from alkyl, aralkyl, cycloalkyl, cycloalkylalkyl, heterocyclyl, heteroaryl, or aryl; or two of G$^1$, G$^2$, G$^3$, G$^4$, and G$^5$ are G$^6$ taken together to form an optionally substituted saturated, partially unsaturated or unsaturated carbocyclic or heteroatom-containing ring of up to about 20 ring atoms which is monocyclic or polycyclic, fused or unfused, and no more than four of G$^1$, G$^2$, G$^3$, G$^4$, and G$^5$ are G$^6$. Similarly to the compounds of Formula 3-I, any of G$^1$, G$^2$, G$^3$, G$^4$, or G$^5$ are optionally substituted by oxo, thioxo, alkyl, alkenyl, alkynyl, heteroaryl, or aryl moieties. In some embodiments, such substitution induces stereoselectivity in chirally controlled oligonucleotide production.

In some embodiments, a chiral reagent has one of the following formulae:

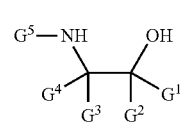

Formulae 3-AB

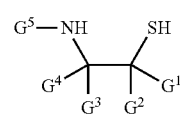

3-BB

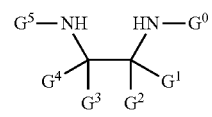

3-CC

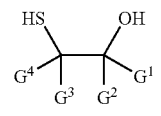

3-DD

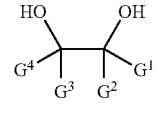

3-EE

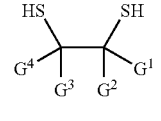

3-FF

In some embodiments, a chiral reagent is an aminoalcohol. In some embodiments, a chiral reagent is an aminothiol. In some embodiments, a chiral reagent is an aminophenol. In some embodiments, a chiral reagent is (S)- and (R)-2-methylamino-1-phenylethanol, (1R, 2S)-ephedrine, or (1R, 2S)-2-methylamino-1,2-diphenylethanol.

In some embodiments of the invention, a chiral reagent is a compound of one of the following formulae:

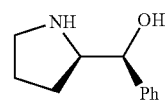

Formula O

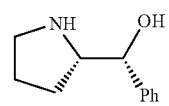

Formula P

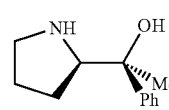

Formula Q

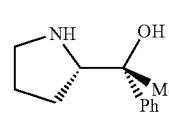

Formula R

The choice of chiral reagent, for example, the isomer represented by Formula Q or its stereoisomer, Formula R, permits specific control of chirality at a linkage phosphorus. Thus, either an Rp or Sp configuration can be selected in each synthetic cycle, permitting control of the overall three dimensional structure of a chirally controlled oligonucleotide. In some embodiments, a chirally controlled oligonucleotide has all Rp stereocenters. In some embodiments of the invention, a chirally controlled oligonucleotide has all Sp stereocenters. In some embodiments of the invention, each linkage phosphorus in the chirally controlled oligonucleotide is independently Rp or Sp. In some embodiments of the invention, each linkage phosphorus in the chirally controlled oligonucleotide is independently Rp or Sp, and at least one is Rp and at least one is Sp. In some embodiments, the selection of Rp and Sp centers is made to confer a specific three dimensional superstructure to a chirally controlled oligonucleotide. Exemplary such selections are described in further detail herein.

In some embodiments, a chiral reagent for use in accordance with the present invention is selected for its ability to be removed at a particular step in the above-depicted cycle. For example, in some embodiments it is desirable to remove a chiral reagent during the step of modifying the linkage phosphorus. In some embodiments, it is desirable to remove a chiral reagent before the step of modifying the linkage phosphorus. In some embodiments, it is desirable to remove a chiral reagent after the step of modifying the linkage phosphorus. In some embodiments, it is desirable to remove a chiral reagent after a first coupling step has occurred but before a second coupling step has occurred, such that a chiral reagent is not present on the growing oligonucleotide during the second coupling (and likewise for additional subsequent coupling steps). In some embodiments, a chiral reagent is removed during the "deblock" reaction that occurs after modification of the linkage phosphorus but before a subsequent cycle begins. Exemplary methods and reagents for removal are described herein.

In some embodiments, removal of chiral auxiliary is achieved when performing the modification and/or deblocking step, as illustrated in Scheme I. It can be beneficial to combine chiral auxiliary removal together with other transformations, such as modification and deblocking. A person of ordinary skill in the art would appreciate that the saved steps/transformation could improve the overall efficiency of synthesis, for instance, with respect to yield and product purity, especially for longer oligonucleotides. One example wherein the chiral auxiliary is removed during modification and/or deblocking is illustrated in Scheme I.

In some embodiments, a chiral reagent for use in accordance with methods of the present invention is characterized in that it is removable under certain conditions. For instance, in some embodiments, a chiral reagent is selected for its ability to be removed under acidic conditions. In certain embodiments, a chiral reagent is selected for its ability to be removed under mildly acidic conditions. In certain embodiments, a chiral reagent is selected for its ability to be removed by way of an E1 elimination reaction (e.g., removal occurs due to the formation of a cation intermediate on the chiral reagent under acidic conditions, causing the chiral reagent to cleave from the oligonucleotide). In some embodiments, a chiral reagent is characterized in that it has a structure recognized as being able to accommodate or facilitate an E1 elimination reaction. One of skill in the relevant arts will appreciate which structures would be envisaged as being prone toward undergoing such elimination reactions.

In some embodiments, a chiral reagent is selected for its ability to be removed with a nucleophile. In some embodiments, a chiral reagent is selected for its ability to be removed with an amine nucleophile. In some embodiments, a chiral reagent is selected for its ability to be removed with a nucleophile other than an amine.

In some embodiments, a chiral reagent is selected for its ability to be removed with a base. In some embodiments, a chiral reagent is selected for its ability to be removed with an amine. In some embodiments, a chiral reagent is selected for its ability to be removed with a base other than an amine.

Further Embodiments of Chiral Reagents

In some embodiments, the present invention is directed to a chiral reagent that is used to synthesize chirally controlled oligonucleotides.

In some embodiments, the present invention provides chiral reagents that are stable to the coupling, capping, modifying and deblocking steps described above and herein. In some embodiments, the present invention provides chiral reagents that are stable to the modifying and deblocking steps described above and herein. In some embodiments, the present invention provides chiral reagents that are stable to the sulfurization and deblocking steps described above and herein. In some embodiments, the present invention provides chiral reagents that are stable to the oxidation step described above and herein. In some embodiments, such a chiral reagent has a structure of formula Z-I.

In some embodiments, the present invention provides chiral reagents that are removed by treatment with a base and/or a nucleophile. In some embodiments, the present invention provides chiral reagents that are removed by treatment with a base and/or a nucleophile, and are stable to the coupling, capping, modifying and deblocking steps described above and herein. In some embodiments, the present invention provides chiral reagents that are removed by treatment comprising an amine. In some embodiments, the present invention provides chiral reagents that are removed by treatment comprising an amine, and are stable to the coupling, capping, modifying and deblocking steps described above and herein. In some embodiments, the present invention provides chiral reagents that are removed by the deprotection/cleavage conditions described in this application, and are stable to the coupling, capping, modifying and deblocking steps described above and herein. In some embodiments, such a chiral reagent has a structure of formula Z-I.

In some embodiments, the chiral reagents that are stable to the coupling, capping, modifying and deblocking steps are used to synthesize chirally controlled oligonucleotides described above and herein. In some embodiments, the chiral reagents that are stable to the coupling, capping, modifying and deblocking steps are used to synthesize chirally controlled oligonucleotides described above and herein, wherein the chirally controlled oligonucleotides comprise one or more phosphate diester or phosphorothioate diester linkages. In some embodiments, the chiral reagents that are stable to the coupling, capping, modifying and deblocking steps are used to synthesize chirally controlled oligonucleotides comprising one or more phosphate diester or phosphorothioate diester linkages, and are not removed until the desired oligonucleotide lengths have been achieved. In some embodiments, the chiral reagents that are stable to the coupling, capping, modifying and deblocking steps are used to synthesize chirally controlled oligonucleotides comprising one or more phosphate diester or phosphorothioate diester linkages, and are not removed until after cycle exit. In some embodiments, the chiral reagents that are stable to the coupling, capping, modifying and deblocking steps are used to synthesize chirally controlled oligonucleotides comprising one or more phosphate diester or phosphorothioate diester linkages, and are not removed until cleavage from solid support. In some embodiments, the chiral reagents that are stable to the coupling, capping, modifying and deblocking steps are used to synthesize chirally controlled oligonucleotides comprising one or more phosphate diester or phosphorothioate diester linkages, and are not removed until cleavage from solid support, and the removal is performed in the same step as cleavage from solid support. In some embodiments, such a chiral reagent has a structure of formula Z-I.

In some embodiments, when a chiral reagent that is stable to the coupling, capping, modifying and deblocking steps is used in oligonucleotide synthesis, the oligonucleotide with 5'-OH ready for coupling can be from any synthetic cycle, including those described in Schemes I, I-b, I-c, I-d, Z-1 and Z-2. In some embodiments, the oligonucleotide with 5'-OH for coupling comprises various types of internucleotidic linkages as described above and herein. After coupling, the modifying step as described in this application installs the desired modification to the linkage phosphorus. The product can either go to cycle exit before/after deblocking, or enter the next cycle after deblocking the 5'-OH. It is understood by a person of ordinary skill in the art that the next cycle can be any of the synthetic cycles described in this application, including but not limited to those in Schemes I, I-b, I-c, I-d, Z-1 and Z-2.

In some embodiments, a chiral reagent or a salt thereof for use in accordance with the present invention is of chemical formula (Z-I).

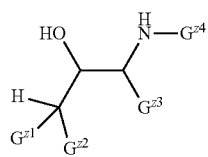

(Z-I)

In the formula (Z-I), $G^{z1}$ and $G^{z2}$ are independently a hydrogen atom, a nitro group (—$NO_2$), a halogen atom, a cyano group (—CN), a group of formula (Z-II) or (Z-III), or both $G^1$ and $G^2$ taken together to form a group of formula (Z-IV).

In some embodiments, a group of formula (Z-II) is as depicted below:

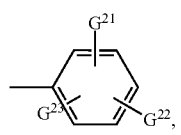

(Z-II)

wherein $G^{21}$ to $G^{23}$ are independently a hydrogen atom, a nitro group, a halogen atom, a cyano group or $C_{1-3}$ alkyl group.

In some embodiments, a group of formula (Z-III) is as depicted below:

(Z-III)

wherein $G^{31}$ to $G^{33}$ are independently $C_{1-4}$ alkyl group, $C_{6-14}$ aryl group $C_{1-4}$ alkoxy group, $C_{7-14}$ aralkyl group, $C_{1-4}$ alkyl $C_{6-14}$ aryl group, $C_{1-4}$ alkoxy $C_{6-14}$ aryl group, or $C_{6-14}$ aryl $C_{1-4}$ alkyl group.

In some embodiments, a group of formula (Z-IV) is as depicted below:

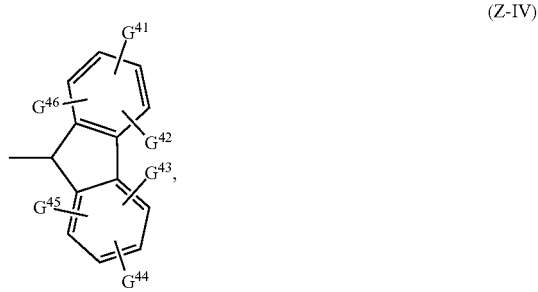

(Z-IV)

wherein $G^{41}$ to $G^{46}$ are independently a hydrogen atom, a nitro group, a halogen atom, a cyano group or $C_{1-3}$ alkyl group.

$G^{z3}$ and $G^{z4}$ are independently a hydrogen atom, $C_{1-3}$ alkyl group, $C_{6-14}$ aryl group, or both $G^{z3}$ and $G^{z4}$ taken together to form a heteroatom-containing ring that has 3 to 16 carbon atoms, together with the NH moiety in formula (Z-I).

In some embodiments, a chiral reagent has following chemical formula (Z-I'):

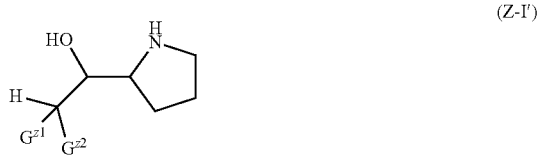

(Z-I')

wherein $G^{z1}$ and $G^{z2}$ are same as above. Namely, $G^{z1}$ and $G^{z2}$ are independently a hydrogen atom, a nitro group, a halogen atom, a cyano group, a group of formula (Z-II) or (Z-III), or both $G^{z1}$ and $G^{z2}$ taken together to form a group of formula (Z-IV).

In certain embodiments, a chiral reagent has chemical formula (Z-I') and each of $G^{z1}$ and $G^2$ is a group of formula (Z-II), wherein $G^{21}$ to $G^{23}$ are independently a hydrogen atom, a nitro group, a halogen atom, a cyano group or $C_{1-3}$ alkyl group.

In certain embodiments, a chiral reagent has chemical formula (Z-I') and each of $G^{z1}$ and $G^{z2}$ is a group of formula (Z-II) and each of $G^{21}$ to $G^{23}$ is a hydrogen atom.

In certain embodiments, a chiral reagent has chemical formula (Z-I') and $G^{z1}$ is a hydrogen atom, $G^{z2}$ is a group of formula (Z-II), and $G^{21}$ to $G^{23}$ are independently a hydrogen atom, a nitro group, a halogen atom, a cyano group or $C_{1-3}$ alkyl group.

In certain embodiments, a chiral reagent has chemical formula (Z-I') and $G^{z1}$ is a hydrogen atom, $G^{z2}$ is a group of formula (Z-II), each of $G^{21}$ and $G^{22}$ is a hydrogen atom and $G^{23}$ is a nitro group.

In certain embodiments, a chiral reagent has chemical formula (Z-I') and $G^{z1}$ is a hydrogen atom and $G^{z2}$ is a group of formula (III), and $G^{31}$ to $G^{33}$ are independently $C_{1-4}$ alkyl group, $C_{6-14}$ aryl group, $C_{7-14}$ aralkyl group, $C_{1-4}$ alkyl $C_{6-14}$ aryl group, $C_{1-4}$ alkoxy $C_{6-14}$ aryl group, or $C_{6-14}$ aryl $C_{1-4}$ alkyl group.

In some embodiments, the chiral reagent has chemical formula (I') and $G^1$ is a hydrogen atom and $G^2$ is a group of formula (III), and $G^{31}$ to $G^{33}$ are independently $C_{1-4}$ alkyl group, $C_6$ aryl group, $C_{7-10}$ aralkyl group, $C_{1-4}$ alkyl $C_6$ aryl group, $C_{1-4}$ alkoxy $C_6$ aryl group, or $C_6$ aryl $C_{1-4}$ alkyl group.

In certain embodiments, a chiral reagent has chemical formula (Z-I') and $G^{z1}$ is a hydrogen atom, $G^{z2}$ is a group of formula (Z-III), and $G^{31}$ to $G^{33}$ are independently $C_{1-4}$ alkyl group or $C_6$ aryl group. Examples of $C_{1-4}$ alkyl group are methyl group, ethyl group, n-propyl group, iso-propyl group, n-buthyl group and tert-buthyl group.

In certain embodiments, a chiral reagent has chemical formula (Z-I') and $G^{z1}$ is a hydrogen atom, $G^{z2}$ is a group of formula (Z-III), and $G^{31}$ to $G^{33}$ are independently $C_{1-4}$ alkyl group.

In certain embodiments, a chiral reagent has chemical formula (Z-I') and $G^{z1}$ is a hydrogen atom, $G^{z2}$ is a group of formula (Z-III), and $G^{31}$ and $G^{33}$ are $C_6$ aryl group and $G^{32}$ is $C_{1-4}$ alkyl group.

In certain embodiments, a chiral reagent has chemical formula (Z-I') and $G^{z1}$ and $G^{12}$ are taken together to form a group of formula (Z-IV), and $G^{41}$ to $G^{46}$ are independently a hydrogen atom, a nitro group, a halogen atom, a cyano group or $C_{1-4}$ alkyl group.

In certain embodiments, a chiral reagent has chemical formula (Z-I') and $G^{z1}$ and $G^{z2}$ are taken together to form a group of formula (Z-IV), wherein each of $G^{41}$ to $G^{46}$ is a hydrogen atom.

In certain embodiments, a chiral reagent is selected from one of chemical formulae 3a, 3b, 5a, Z-5b, 7a, 7b, 9a, 9b, 11a and 11b:

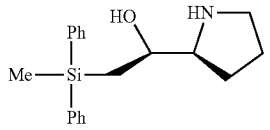

(3a)

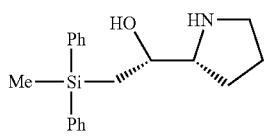

(3b)

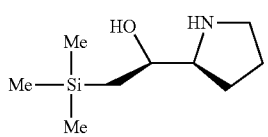

(5a)

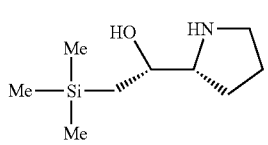

(Z-5b)

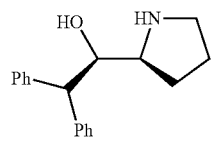

(7a)

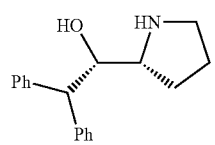

(7b)

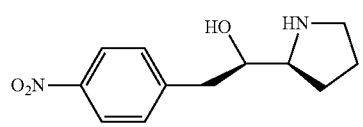

(9a)

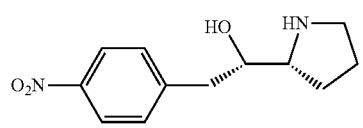

(9b)

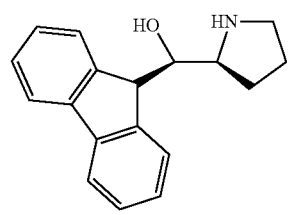

(11a)

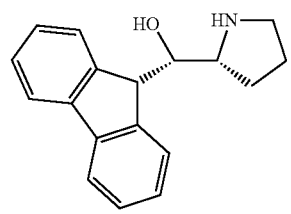

(11b)

In some embodiments, a nucleoside 3'-phosphoramidite derivative for use in accordance with the present invention is represented by formula (Z-Va) or (Z-Vb):

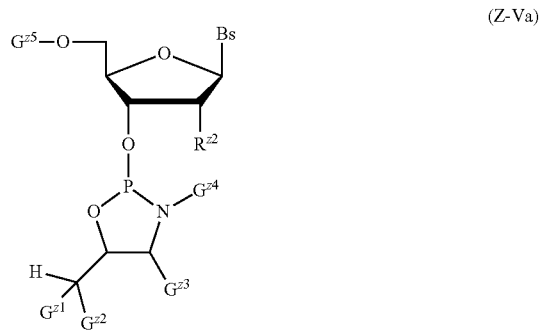

(Z-Va)

-continued

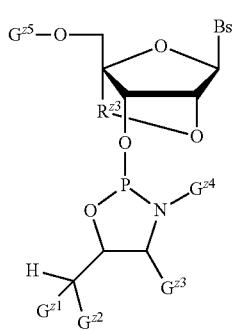
(Z-Vb)

wherein $G^{z1}$ to $G^{z4}$ are the same as above, $G^{z5}$ is a protective group of the hydroxyl group, and Bs is a group selected from the groups represented by following formula (Z-VI) to (Z-XI), or derivatives thereof.

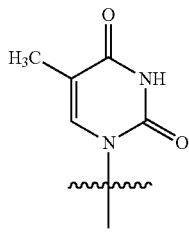
(Z-VI)

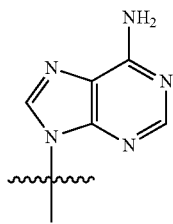
(Z-VII)

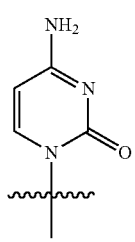
(Z-VIII)

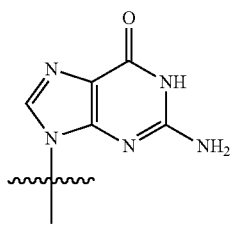
(Z-IX)

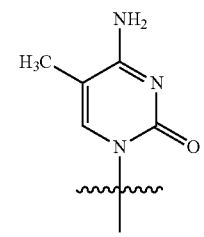
(Z-X)

(Z-XI)

Examples of Bs are an adenine, a thymine, a cytosine, a guanine, an uracil, a 5-methylcytosine or derivative thereof; $R^{z2}$ is independently hydrogen, —OH, —SH, —NR$^d$R$^d$, —N$_3$, halogen, alkyl, alkenyl, alkynyl, alkyl-Y$^1$—, alkenyl-Y$^1$—, alkynyl-Y$^1$—, aryl-Y$^1$—, heteroaryl-Y$^1$—, —OR$^b$, or —SR$^b$, wherein R$^b$ is a blocking moiety; Y$^1$ is O, NR$^d$, S, or Se;

R$^d$ is independently hydrogen, alkyl, alkenyl, alkynyl, aryl, acyl, substituted silyl, carbamate, —P(O)(R$^e$)$_2$, or —HP(O)(R$^e$);

R$^e$ is independently hydrogen, alkyl, aryl, alkenyl, alkynyl, alkyl-Y$^2$—, alkenyl-Y$^2$—, alkynyl-Y$^2$—, aryl-Y$^2$—, or heteroaryl-Y$^2$—, or a cation which is Na$^+$, Li$^+$, or K$^+$, or —O$^-$; Y$^2$ is O, NR$^d$, or S;

R$^{z3}$ is a group represented by —CH$_2$—, —(CH$_2$)$_2$—, —CH$_2$NH—, or —CH$_2$N(CH$_3$)—.

Examples of G$^5$ are trityl, 4-monomethoxytrityl, 4,4'-dimethoxytrityl, 4,4',4''-trimethoxytrityl, 9-phenylxanthin-9-yl (Pixyl) and 9-(p-methoxyphenyl)xanthin-9-yl (MOX).

In some embodiments, a nucleoside 3'-phosphoramidite derivative is represented by formula (Z-Va') or (Z-Vb'):

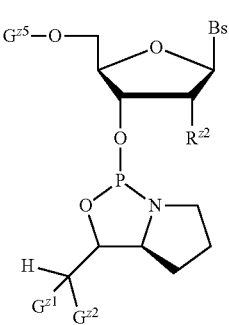
(Z-Va')

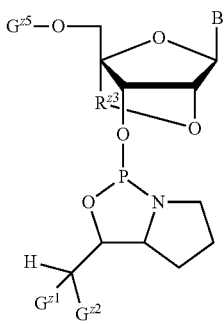

(Z-Vb')

wherein each of $G^{z1}$, $G^{z2}$, $G^{z5}$, Bs, $R^{z2}$, and $R^{z3}$ is independently as defined above and described herein.

In some embodiments, the invention relates to a method for synthesis of a chirally controlled oligonucleotide.

In some embodiments, a provided method comprises a first step of reacting a molecule comprising an achiral H-phosphonate moiety, the first activating reagent and a chiral reagent or a salt thereof to form a monomer. In some embodiments, a chiral reagent has chemical formula (Z-I) and the monomer may be represented by formula (Z-Va), (Z-Vb), (Z-Va'), or (Z-Vb'). The monomer reacts with the second activating reagent and a nucleoside to form a condensed intermediate. In some embodiments, a subsequent step comprises converting the condensed intermediate to the nucleic acid comprising a chiral X-phosphonate moiety.

In some embodiments, the present methods provide stable and commercially available materials as starting materials. In some embodiments, the present methods provide a stereocontrolled phosphorous atom-modified oligonucleotide using an achiral starting material.

As shown in the working examples, in some embodiments methods of the present invention do not cause degradation during deprotection steps. Further the method does not require special capping agents to produce phosphorus atom-modified oligonucleotide derivatives.

In some embodiments, the present invention provides a method for synthesis of stereocontrolled phosphorus atom-modified oligonucleotide derivatives using a chiral monomer. In some embodiments, the first step is reacting a nucleoside 3'-phosphoramidite derivative which is represented by formula (Z-Va), (Z-Vb), (Z-Va'), or (Z-Vb') with the second activating reagent and a nucleoside to form a condensed intermediate. The second step is converting the condensed intermediate to the nucleic acid comprising a chiral X-phosphonate moiety.

All publications and patent applications disclosed herein in this specification are herein incorporated by reference in their entirety to the same extent as if each individual publication or patent application was specifically and individually indicated to be incorporated by reference.

As used in this "Further Embodiments of Chiral Reagents" section, in a condensation reaction, the term "activating reagent" refers to a reagent that activates a less reactive site and renders it more susceptible to attack by a nucleophile.

As used in this "Further Embodiments of Chiral Reagents" section, an "alkyl" group refers to an aliphatic hydrocarbon group. The alkyl moiety may be a saturated alkyl group (which means that it does not contain any units of unsaturation, e.g. carbon-carbon double bonds or carbon-carbon triple bonds) or the alkyl moiety may be an unsaturated alkyl group (which means that it contains at least one unit of unsaturation). The alkyl moiety, whether saturated or unsaturated, may be branched, straight chain, or include a cyclic portion. The point of attachment of an alkyl is at a carbon atom that is not part of a ring. The "alkyl" moiety may have 1 to 10 carbon atoms (whenever it appears herein, a numerical range such as "1 to 10" refers to each integer in the given range; e.g., "1 to 10 carbon atoms" means that the alkyl group may consist of 1 carbon atom, 2 carbon atoms, 3 carbon atoms, etc., up to and including 10 carbon atoms, although the present definition also covers the occurrence of the term "alkyl" where no numerical range is designated). Alkyl includes both branched and straight chain alkyl groups. The alkyl group of the compounds described herein may be designated as "$C_1$-$C_6$ alkyl" or similar designations. By way of example only, "$C_1$-$C_6$ alkyl" indicates that there are one, two, three, four, five, or six carbon atoms in the alkyl chain, i.e., the alkyl chain is selected from e.g., methyl, ethyl, propyl, iso-propyl, n-butyl, iso-butyl, sec-butyl, and tert-butyl. Typical alkyl groups include, but are in no way limited to, methyl, ethyl, propyl, isopropyl, butyl, isobutyl, tertiary butyl, pentyl, hexyl, allyl, cyclopropylmethyl, cyclobutylmethyl, cyclopentylmethyl, cyclohexylmethyl, and the like. In one aspect, an alkyl is a $C_1$-$C_6$ alkyl. $C_{1-3}$ alkyl group means straight or branched alkyl group that has 1 to 3 carbon atoms. Examples of $C_{1-3}$ alkyl group are methyl, ethyl, propyl and isopropyl. $C_{1-4}$ alkyl group means straight or branched alkyl group that has 1 to 4 carbon atoms. Examples of $C_{1-4}$ alkyl group are methyl, ethyl, propyl, isopropyl, butyl, isobutyl, and tert-butyl.

As used in this "Further Embodiments of Chiral Reagents" section, the term "aryl" refers to an aromatic ring wherein each of the atoms forming the ring is a carbon atom. Aryl rings are formed by five, six, seven, eight, nine, or more than nine carbon atoms. Aryl groups are a substituted or unsubstituted. In one aspect, an aryl is a phenyl or a naphthalenyl. Depending on the structure, an aryl group can be a monoradical or a diradical (i.e., an arylene group). In one aspect, an aryl is a $C_6$-$C_{10}$ aryl. $C_{6-14}$ aryl group means aryl group that has 6 to 14 carbon atoms. The examples of $C_{6-14}$ aryl group are phenyl, biphenyl, naphthyl, anthracyl, indanyl, phthalimidyl, naphthimidyl, phenanthridinyl, and tetrahydronaphthyl.

The term "aralkyl" refers to an alkyl group substituted with an aryl group. Suitable aralkyl groups include benzyl, picolyl, and the like, all of which may be optionally substituted.

As used in this "Further Embodiments of Chiral Reagents" section, An "acyl moiety" refers to an alkyl (C=O), aryl(C=O), or aralkyl(C=O) group. An acyl moiety can have an intervening moiety (Y) that is oxy, amino, thio, or seleno between the carbonyl and the hydrocarbon group. For example, an acyl group can be alkyl-Y—(C=O), aryl-Y—(C=O) or aralkyl-Y—(C=O).

As used in this "Further Embodiments of Chiral Reagents" section, "alkenyl" groups are straight chain, branch chain, and cyclic hydrocarbon groups containing at least one carbon-carbon double bond. Alkenyl groups can be substituted.

As used in this "Further Embodiments of Chiral Reagents" section, "alkynyl" groups are straight chain, branch chain, and cyclic hydrocarbon groups containing at least one carbon-carbon triple bond. Alkynyl groups can be substituted.

As used in this "Further Embodiments of Chiral Reagents" section, an "alkoxy" group refers to an alkyl group linked to oxygen i.e. (alkyl)-O— group, where alkyl is as defined herein. Examples include methoxy (—OCH3) or ethoxy (—OCH2CH3) groups.

As used in this "Further Embodiments of Chiral Reagents" section, an "alkenyloxy" group refers to an alkenyl group linked to oxygen i.e. (alkenyl)-O— group, where alkenyl is as defined herein.

As used in this "Further Embodiments of Chiral Reagents" section, an "alkynyloxy" group refers to an alkynyl group linked to oxygen i.e. (alkynyl)-O— group, where alkynyl is as defined herein.

As used in this "Further Embodiments of Chiral Reagents" section, an "aryloxy" group refers to an aryl group linked to oxygen i.e. (aryl)-O-group, where the aryl is as defined herein. An example includes phenoxy (—OC$_6$H$_5$) group.

As used in this "Further Embodiments of Chiral Reagents" section, the term "alkylseleno" refers to an alkyl group having a substituted seleno group attached thereto i.e. (alkyl)-Se— group, wherein alkyl is defined herein.

As used in this "Further Embodiments of Chiral Reagents" section, the term "alkenylseleno" refers to an alkenyl group having a substituted seleno group attached thereto i.e. (alkenyl)-Se— group, wherein alkenyl is defined herein.

As used in this "Further Embodiments of Chiral Reagents" section, the term "alkynylseleno" refers to an alkynyl group having a substituted seleno group attached thereto i.e. (alkynyl)-Se— group, wherein alkenyl is defined herein.

As used in this "Further Embodiments of Chiral Reagents" section, the term "alkylthio" refers to an alkyl group attached to a bridging sulfur atom i.e. (alkyl)-S-group, wherein alkyl is defined herein. For example, an alkylthio is a methylthio and the like.

As used in this "Further Embodiments of Chiral Reagents" section, the term "alkenylthio" refers to an alkenyl group attached to a bridging sulfur atom i.e. (alkenyl)-S— group, wherein alkenyl is defined herein.

As used in this "Further Embodiments of Chiral Reagents" section, the term "alkynylthio" refers to an alkynyl group attached to a bridging sulfur atom i.e. (alkynyl)-S— group, wherein alkenyl is defined herein.

As used in this "Further Embodiments of Chiral Reagents" section, the term "alkylamino" refers to an amino group substituted with at least one alkyl group i.e. —NH(alkyl) or —N(alkyl)2, wherein alkyl is defined herein.

As used in this "Further Embodiments of Chiral Reagents" section, the term "alkenylamino" refers to an amino group substituted with at least one alkenyl group Le —NH(alkenyl) or —N(alkenyl)$_2$, wherein alkenyl is defined herein.

As used in this "Further Embodiments of Chiral Reagents" section, the term "alkynylamino" refers to an amino group substituted with at least one alkynyl group i.e. —NH(alkynyl) or —N(alkynyl)$_2$, wherein alkynyl is defined herein.

As used in this "Further Embodiments of Chiral Reagents" section, the term "halogen" is intended to include fluorine, chlorine, bromine and iodine.

As used in this "Further Embodiments of Chiral Reagents" section, a "fluorescent group" refers to a molecule that, when excited with light having a selected wavelength, emits light of a different wavelength. Fluorescent groups include, but are not limited to, indole groups, fluorescein, tetramethylrhodamine, Texas Red, BODIPY, 5-[(2-aminoethyl)amino]napthalene-1-sulfonic acid (EDANS), coumarin and Lucifer yellow.

As used in this "Further Embodiments of Chiral Reagents" section, an "ammonium ion" is a positively charged polyatomic cation of the chemical formula NH$_4^+$.

As used in this "Further Embodiments of Chiral Reagents" section, an "alkylammonium ion" is an ammonium ion that has at least one of its hydrogen atoms replaced by an alkyl group, wherein alkyl is defined herein. Examples include triethylammonium ion, N, N-diisopropylethylammonium ion.

As used in this "Further Embodiments of Chiral Reagents" section, an "iminium ion" has the general structure $(R^x)_2C=N(R^x)_2^+$ The $R^x$ groups refer to alkyl, alkenyl, alkynyl, aryl groups as defined herein. A "heteroaromatic iminium ion" refers to an imminium ion where the nitrogen and its attached $R^x$ groups form a heteroaromatic ring. A "heterocyclic iminium ion" refers to an imminium ion where the nitrogen and its attached $R^x$ groups form a heterocyclic ring.

As used in this "Further Embodiments of Chiral Reagents" section, the terms "amino" or "amine" refers to a —N(R$^h$)$_2$ radical group, where each R$^h$ is independently hydrogen, alkyl, fluoroalkyl, carbocyclyl, carbocyclylalkyl, aryl, aralkyl, heterocyclyl, heterocyclylalkyl, heteroaryl or heteroarylalkyl, unless stated otherwise specifically in the specification. When a —N(R$^h$)$_2$ group has two R$^h$ other than hydrogen they can be combined with the nitrogen atom to form a 4-, 5-, 6-, or 7-membered ring. For example, —N(R$^h$)$_2$ is meant to include, but not be limited to, 1-pyrrolidinyl and 4-morpholinyl. Any one or more of the hydrogen, alkyl, fluoroalkyl, carbocyclyl, carbocyclylalkyl, aryl, aralkyl, heterocyclyl, heterocyclylalkyl, heteroaryl or heteroarylalkyl are optionally substituted by one or more substituents which independently are alkyl, heteroalkyl, alkenyl, alkynyl, cycloalkyl, heterocycloalkyl, aryl, arylalkyl, heteroaryl, heteroarylalkyl, hydroxy, halo, cyano, trifluoromethyl, trifluoromethoxy, nitro, trimethylsilyl, —OR$^i$, —SR$^i$, —OC(O)R$^i$, —N(R$^i$)$_2$, —C(O)R$^i$, —C(O)OR$^i$, —OC(O)N(R$^i$)$_2$, —C(O)N(R$^i$)$_2$, —N(R$^i$)C(O)OR, —N(R$^i$)C(O)R$^i$, —N(R$^i$)C(O)N(R$^i$)$_2$, N(R$^i$)C(NR$^i$)N(R$^i$)$_2$, —N(R$^i$)S(O)$_t$R$^i$(where t is 1 or 2), —S(O), or —S(O)$_t$N(R$^i$)$_2$ (where t is 1 or 2), where each R$^i$ is independently hydrogen, alkyl, fluoroalkyl, carbocyclyl, carbocyclylalkyl, aryl, aralkyl, heterocyclyl, heterocyclylalkyl, heteroaryl or heteroarylalkyl.

As used in this "Further Embodiments of Chiral Reagents" section, "carbamate" as used herein, refers to a moiety attached to an amino group which has the formula —C(O)OR where R is alkyl, fluoroalkyl, carbocyclyl, carbocyclylalkyl, aryl, aralkyl, heterocyclyl, heterocyclylalkyl, heteroaryl or heteroarylalkyl. Examples include but are not limited to Boc (tert-butyl-OC(O)—), CBz (benzyl-OC(O)—), Teoc (Me$_3$SiCH$_2$CH$_2$OC(O)—), alloc (allyl-OC(O)—), or Fmoc (9-fluorenylmethyl-OC(O)—) group As used in this "Further Embodiments of Chiral Reagents" section, "substituted silyl" as used herein, refers to a moiety which has the formula R$^x_3$Si—. Examples include, but are not limited to, TBDMS (tert-butyldimethylsilyl), TBDPS (tert-butyldiphenylsilyl) or TMS (trimethylsilyl).

As used in this "Further Embodiments of Chiral Reagents" section, the term "thiol" refers to —SH groups, and include substituted thiol groups i.e. —SRJ groups, wherein RJ are each independently a substituted or unsubstituted alkyl, cycloalkyl, alkenyl, alkynyl, aryl aralkyl, heterocyclyl or heterocyclylalkyl group as defined herein.

In some embodiments, the present invention provides a chiral reagent or a salt thereof. In some embodiments, a chiral reagent is of the following chemical formula (Z-I):

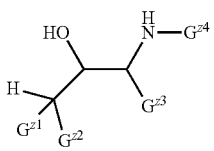

(Z-I)

wherein $G^{z1}$ and $G^{z2}$ are independently a hydrogen atom, a nitro group, a halogen atom, a cyano group (—CN), a group of formula (Z-II) or (Z-III), or both $G^{z1}$ and $G^{z2}$ taken together to form a group of formula (Z-IV). In some embodiments, the term "chiral reagent" is a chemical composition which is used to produce stereocontrolled phosphorous atom-modified nucleotide or oligonucleotide derivatives. A chiral reagent reacts with a nucleoside to form a chiral intermediate.

In some embodiments, a group of formula (Z-II) is of the following formula:

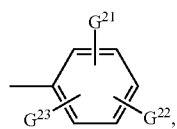

(Z-II)

wherein $G^{21}$ to $G^{23}$ are independently a hydrogen atom, a nitro group, a halogen atom, a cyano group or $C_{1-3}$ alkyl group. In some embodiments, examples of $G^{21}$ to $G^{23}$ are a hydrogen atom.

In some embodiments, a group of formula (Z-III) is of the following formula:

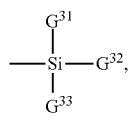

(Z-III)

wherein $G^{31}$ to $G^{33}$ are independently $C_{1-4}$ alkyl group, $C_{6-14}$ aryl group, $C_{1-4}$ alkoxy group, $C_{7-14}$ aralkyl group, $C_{1-4}$ alkyl $C_{6-14}$ aryl group, $C_{1-4}$ alkoxy $C_{6-14}$ aryl group, or $C_{6-14}$ aryl $C_{1-4}$ alkyl group. Examples of $C_{1-4}$ alkyl $C_{6-14}$ aryl group are methylphenyl group, and ethylphenyl group. Examples of $C_{1-4}$ alkoxy $C_{6-14}$ aryl group are methoxyphenyl group and ethoxyphenyl group. Examples of $C_{6-14}$ aryl $C_{1-4}$ alkyl groups are benzyl group and phenylethyl group. In some embodiments, examples of $G^{31}$ to $G^{33}$ are independently a methyl group and a phenyl group.

In some embodiments, a group of formula (Z-IV) is of the following formula:

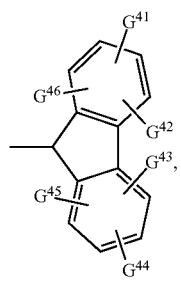

(Z-IV)

wherein $G^{41}$ to $G^{46}$ are independently a hydrogen atom, a nitro group, a halogen atom, a cyano group or $C_{1-3}$ alkyl group. In some embodiments, examples of $G^{41}$ to $G^{46}$ are a hydrogen atom.

$G^{z3}$ and $G^{z4}$ are independently a hydrogen atom, $C_{1-3}$ alkyl group, $C_{6-14}$ aryl group, or both $G^{z3}$ and $G^{z4}$ taken together to form a heteroatom-containing ring that has 3 to 16 carbon atoms. In some embodiments, examples of $G^3$ and $G^4$ are that taken together to form a heteroatom-containing ring that has 3 to 16 carbon atoms with NH moiety in the formula (I).

In certain embodiments, a chiral reagent has following chemical formula (Z-I').

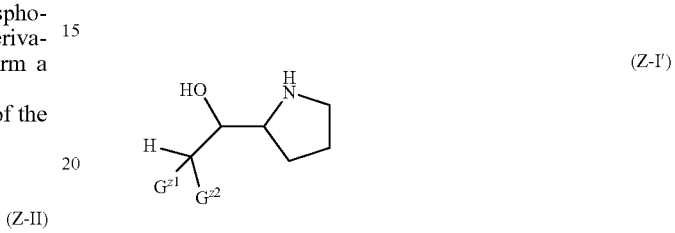

(Z-I')

In the formula (Z-I'), $G^{z1}$ and $G^{z2}$ are same as above and $G^{z1}$ and $G^{z2}$ are independently a hydrogen atom, a nitro group, a halogen atom, a cyano group, a group of formula (Z-II) or (Z-III), or both $G^{z1}$ and $G^{z2}$ taken together to form a group of formula (Z-IV).

In certain embodiments, a chiral reagent has chemical formula (Z-I') and each of $G^{z1}$ and $G^{z2}$ is a group of formula (Z-II), wherein $G^{21}$ to $G^{23}$ are independently a hydrogen atom, a nitro group, a halogen atom, a cyano group or $C_{1-3}$ alkyl group.

In certain embodiments, a chiral reagent has chemical formula (Z-I') and each of $G^{z1}$ and $G^{z2}$ is a group of formula (Z-II) and each of $G^{21}$ to $G^{23}$ is a hydrogen atom.

In certain embodiments, a chiral reagent has chemical formula (Z-I') and $G^{z1}$ is a hydrogen atom, $G^{z2}$ is a group of formula (Z-II), and $G^{21}$ to $G^{23}$ are independently a hydrogen atom, a nitro group, a halogen atom, a cyano group or $C_{1-3}$ alkyl group.

In certain embodiments, a chiral reagent has chemical formula (Z-I') and $G^{z1}$ is a hydrogen atom, $G^{12}$ is a group of formula (Z-II), each of $G^{21}$ and $G^{22}$ is a hydrogen atom and $G^{23}$ is a nitro group (—NO$_2$).

In certain embodiments, a chiral reagent has chemical formula (Z-I') and $G^{z1}$ is a hydrogen atom and $G^{z2}$ is a group of formula (Z-III), and $G^{31}$ to $G^{33}$ are independently $C_{1-4}$ alkyl group, $C_{6-14}$ aryl group, $C_{7-14}$ aralkyl group, $C_{1-4}$ alkyl $C_{6-14}$ aryl group, $C_{1-4}$ alkoxy $C_{6-14}$ aryl group, or $C_{6-14}$ aryl $C_{1-4}$ alkyl group.

In some embodiments, a chiral reagent has chemical formula (Z-I') and $G^{z1}$ is a hydrogen atom, $G^{z2}$ is a group of formula (Z-III), and $G^{31}$ to $G^{33}$ are independently $C_{1-4}$ alkyl group or $C_6$ aryl group (a phenyl group). Examples of $C_{1-4}$ alkyl group are methyl group, ethyl group, n-propyl group, iso-propyl group, n-butyl group and tert-butyl group.

In certain embodiments, a chiral reagent has chemical formula (Z-I') and $G^{z1}$ is a hydrogen atom, $G^{z2}$ is a group of formula (Z-III), and $G^{31}$ to $G^{33}$ are independently $C_{1-2}$ alkyl group (a methyl group or an ethyl group) or $C_6$ aryl group (a phenyl group).

In certain embodiments, a chiral reagent has chemical formula (Z-I') and $G^{z1}$ is a hydrogen atom, $G^{z2}$ is a group of formula (Z-III), and $G^{31}$ to $G^{33}$ are independently $C_{1-4}$ alkyl group.

In certain embodiments, a chiral reagent has chemical formula (Z-I') and $G^{z1}$ is a hydrogen atom, $G^{z2}$ is a group of formula (Z-III), and $G^{31}$ and $G^{33}$ are $C_6$ aryl group (a phenyl group) and $G^{32}$ is $C_{1-2}$ alkyl group.

In certain embodiments, a chiral reagent has chemical formula (Z-I') and $G^{z1}$ and $G^{z2}$ are taken together to form a group of formula (Z-IV), and $G^{41}$ to $G^{46}$ are independently a hydrogen atom, a nitro group, a halogen atom, a cyano group or $C_{1-3}$ alkyl group.

In certain embodiments, a chiral reagent has chemical formula (Z-I') and $G^{z1}$ and $G^{z2}$ are taken together to form a group of formula (Z-IV), wherein each of $G^{41}$ to $G^{46}$ is a hydrogen atom.

In certain embodiments, a chiral reagent is selected from one of chemical formulae 3a, 3b, 5a, Z-5b, 7a, 7b, 9a, 9b, 11a and 11b:

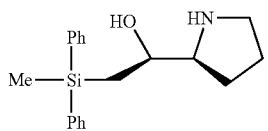
(3a)

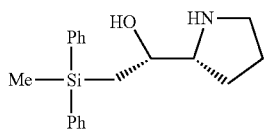
(3b)

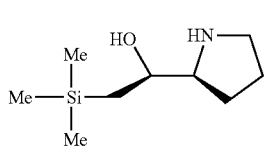
(5a)

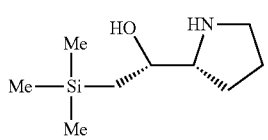
(Z-5b)

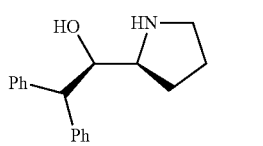
(7a)

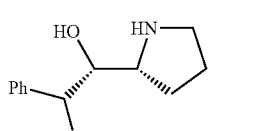
(7b)

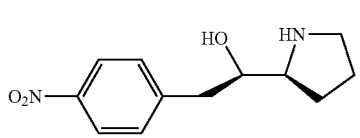
(9a)

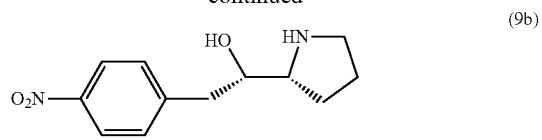
(9b)

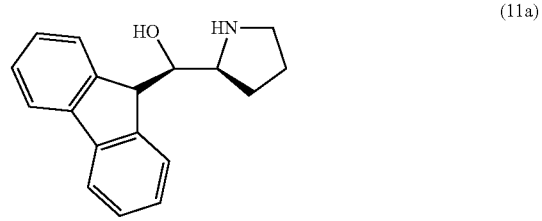 [SMILES: O[C@H](C1c2ccccc2-c2ccccc21)[C@@H]1CCCN1]
(11a)

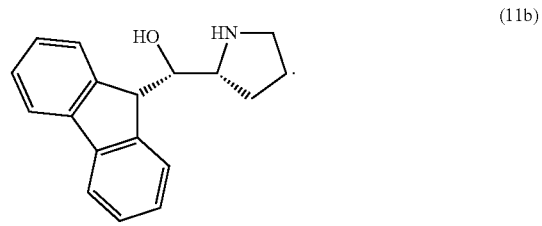
(11b)

Namely, in some embodiments, a chiral reagent is selected from:

(S)-2-(Methyldiphenylsilyl)-1-((S)-1-pyrrolidin-2-yl)ethanol (3a), (R)-2-(Methyldiphenylsilyl)-1-((R)-1-pyrrolidin-2-yl)ethanol (3b), (S)-2-(Trimethylsilyl)-1-((S)-1-pyrrolidin-2-yl)ethanol (5a), (R)-2-(Trimethylsilyl)-1-((R)-1-pyrrolidin-2-yl)ethanol (Z-5b), (R)-2,2-Diphenyl-1-((S)-pyrrolidin-2-yl)ethanol (7a), (S)-2,2-Diphenyl-1-((R)-pyrrolidin-2-yl)ethanol (7b), (R)-2-(4-Nitrophenyl)-1-((S)-pyrrolidin-2-yl)ethanol (9a), (S)-2-(4-Nitrophenyl)-1-((R)-pyrrolidin-2-yl)ethanol (9b), (R)-(9H-Fluororen-9-yl)((S)-pyrrolidin-2-yl)methanol (11a), or (S)-(9H-Fluororen-9-yl)((R)-pyrrolidin-2-yl)methanol (11b).

The chiral reagent reacts with a nucleic acid or modified nucleic acid to be an asymmetric auxiliary group. A nucleoside 3'-phosphoramidite derivative, which is an intermediate of manufacturing a stereocontrolled phosphorous atom-modified oligonucleotide derivative, is obtained by chiral reagent reacting with a nucleic acid or modified nucleic acid.

In some embodiments, the invention provides a nucleoside 3'-phosphoramidite derivative which is represented by formula (Z-Va) or (Z-Vb). The compounds of formula (Z-Va) and (Z-Vb) are known as monomers that are used in synthesizing oligonucleotide derivatives. These compounds are also known as oxazaphospholidine monomers. The sugar moieties of the compounds represented by formula (Z-Vb) are known as BNA and LNA (when $R^{z3}$ is a methylene group).

(Z-Va)

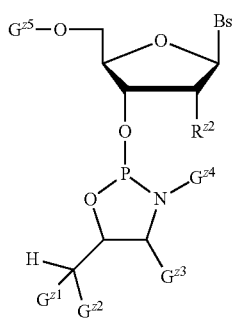

(Z-Vb)

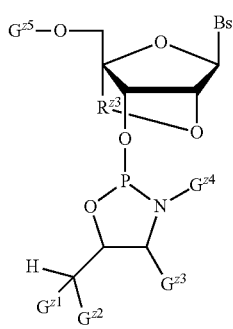

In the formula (Z-Va) and (Z-Va), $G^{z1}$ to $G^{z4}$ are same as above, $G^{z5}$ is a protective group of the hydroxyl group, and Bs is a group selected from the groups represented by formula (Z-VI) to (Z-XI) or derivatives thereof.

(Z-VI)

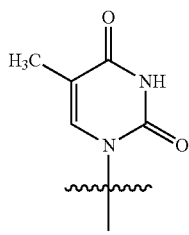

(Z-VII)

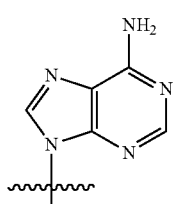

(Z-VIII)

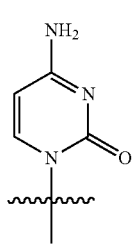

(Z-IX)

(Z-X)

(Z-XI)

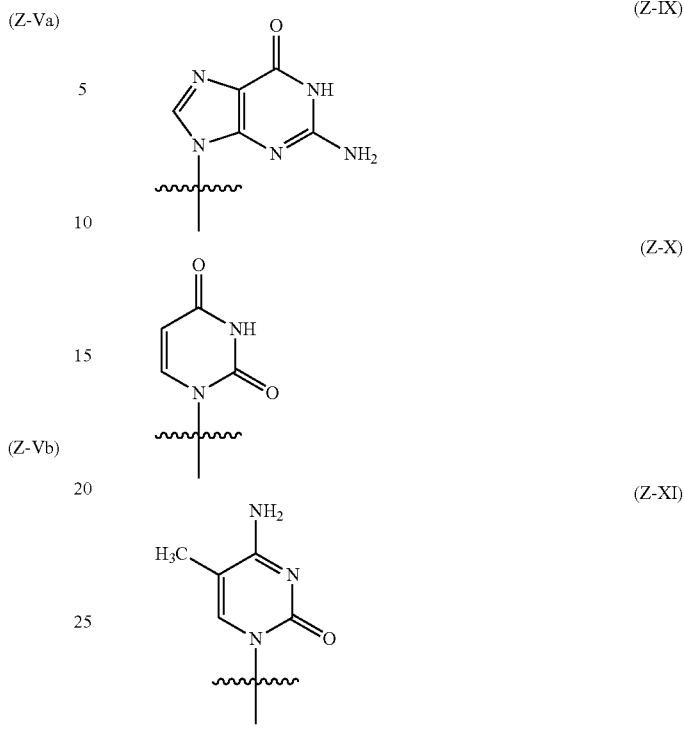

Examples of Bs are an adenine, a thymine, a cytosine, a guanine, an uracil, a 5-methylcytosine or derivative thereof; $R^{z2}$ is independently hydrogen, —OH, —SH, —$NR^dR^d$, —$N_3$, halogen, alkyl, alkenyl, alkynyl, alkyl-$Y^1$—, alkenyl-$Y^1$—, alkynyl-$Y^1$—, aryl-$Y^1$—, heteroaryl-$Y^1$—, —$OR^b$, or —$SR^b$, wherein $R^b$ is a blocking moiety;

$Y^1$ is O, $NR^d$, S, or Se;

$R^d$ is independently hydrogen, alkyl, alkenyl, alkynyl, aryl, acyl, substituted silyl, carbamate, —P(O)($R^e$)$_2$, or —HP(O)($R^e$);

$R^e$ is independently hydrogen, alkyl, aryl, alkenyl, alkynyl, alkyl-$Y^2$—, alkenyl-$Y^2$—, alkynyl-$Y^2$—, aryl-$Y^2$—, or heteroaryl-$Y^2$—, or a cation which is $Na^+$, $Li^+$, or $K^+$, or —$O^-$;

$Y^2$ is O, $NR^d$, or S;

$R^{z3}$ is a group represented by —$CH_2$—, —$(CH_2)_2$—, —$CH_2NH$—, or —$CH_2N(CH_3)$—.

Examples of $G^{z5}$ is trityl, 4-monomethoxytrityl, 4,4'-dimethoxytrityl, 4,4',4''-trimethoxytrityl, 9-phenylxanthin-9-yl (Pixyl) and 9-(p-methoxyphenyl)xanthin-9-yl (MOX).

In some embodiments, Bs is an adenine, a thymine, a cytosine, a guanine, or derivative thereof. In some embodiments, Bs is a nucleobase or a modified nucleobase. Exemplary derivatives are, for instance, those disclosed in JP 2005-89441 A, and are represented as follows:

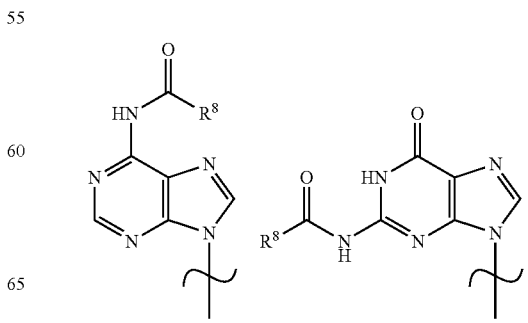

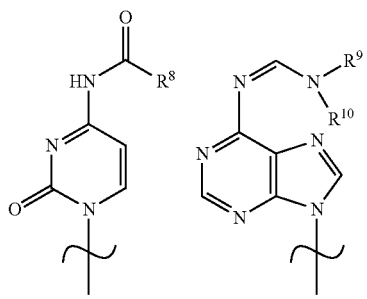

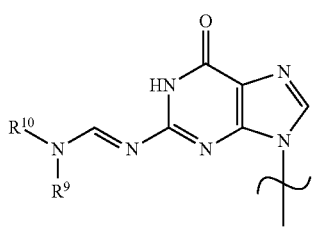

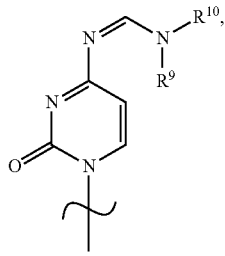

wherein, in the above formula, each of $R^8$ to $R^{10}$ is independently $C_{1-10}$ alkyl, $C_6$-$C_{10}$ aryl, $C_6$-$C_{10}$ aralkyl, or $C_6$-$C_{10}$ aryloxyalkyl. In some embodiments, $R^8$ is methyl, isopropyl, phenyl, benzyl, and phenoxymethyl. In some embodiments, $R^9$ and $R^{10}$ are $C_{1-4}$ alkyl group.

In some embodiments, a nucleoside 3'-phosphoramidite derivative is represented by formula (Z-Va') or (Z-Vb'):

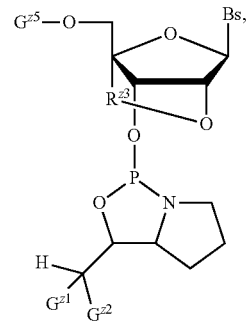

(Z-Va')

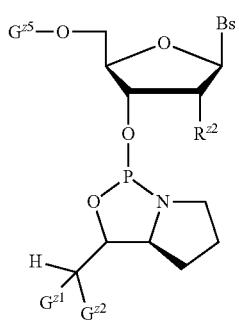

(Z-Vb')

wherein, in the formula (Z-Va') and (Z-Vb'), each of $G^{z1}$, $G^{z2}$, $G^{z5}$, Bs, $R^{z2}$ and $R^{z3}$ are the same as above. In certain embodiments, a nucleoside 3'-phosphoramidite derivative is a chiral monomer which is used to produce stereocontrolled phosphorous atom-modified nucleotide and oligonucleotide. Examples of the nucleoside 3'-phosphoramidite derivatives are represented by the following formulae: 12a, 12b, 13a, 13b, 14a, 14b, 15a, 15b, 16a, 16b, 17a, 17b, 18a, 18b, 19a, 19b, 20a, 20b, 21a, 21b, 22a, 22b, 23a, 23b, 24a, 24b, 25a, 25b, 26a, 26b, 27a, 27b, 28a, 28b, 29a, 29b, 30a, 30b, 31a, 31b, 32a, 32b, 33a, 33b, 34a, 34b and 35a.

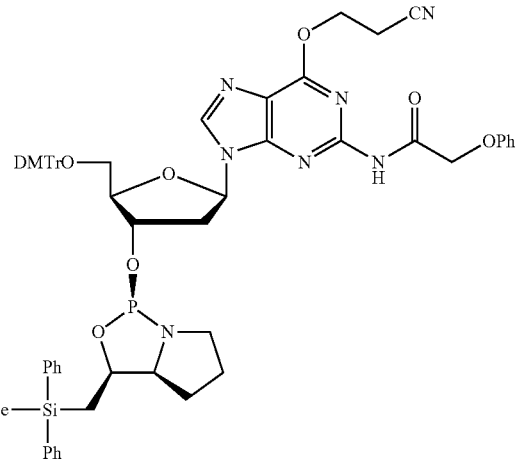

12a

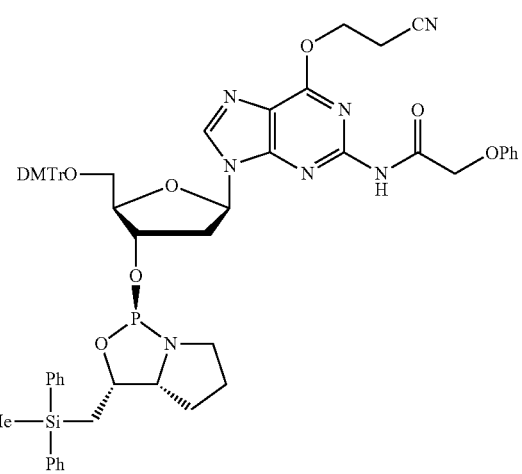

12b

193
-continued
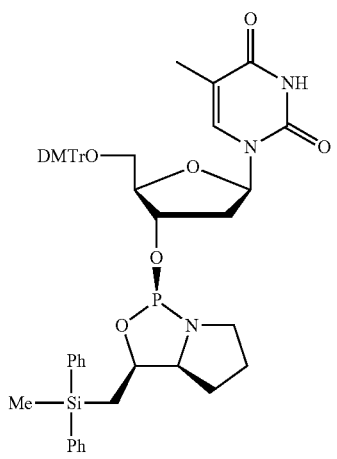
13a
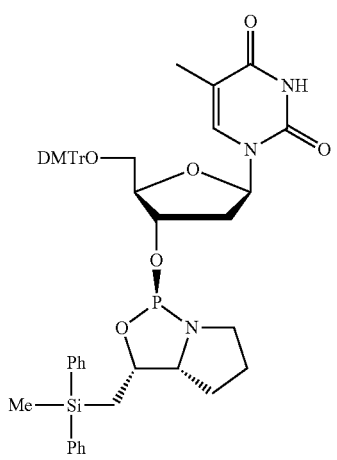
13b
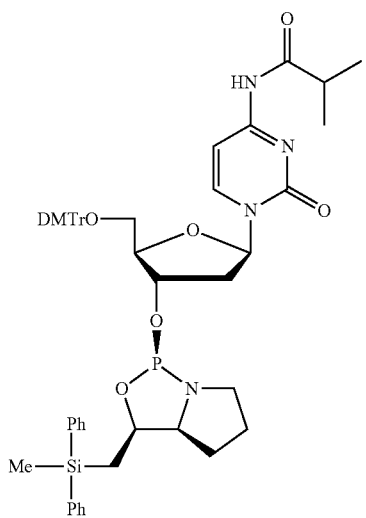
14a
194
-continued
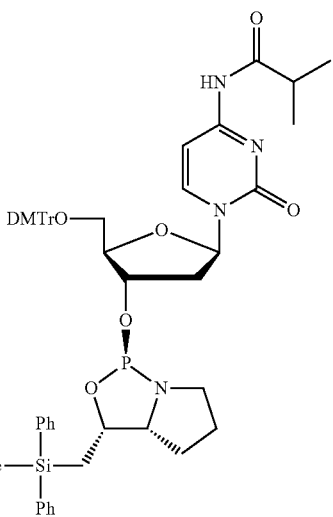
14b
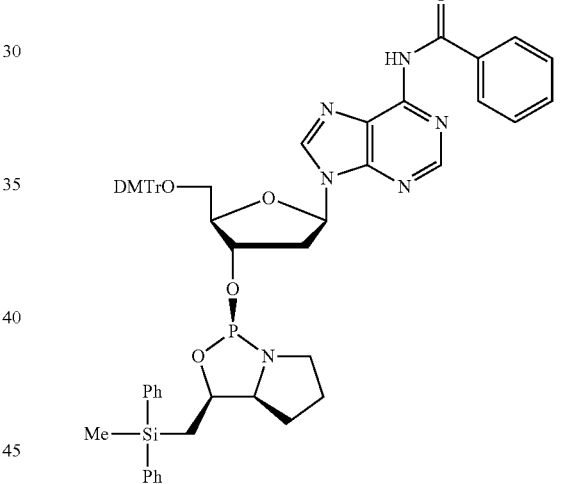
15a
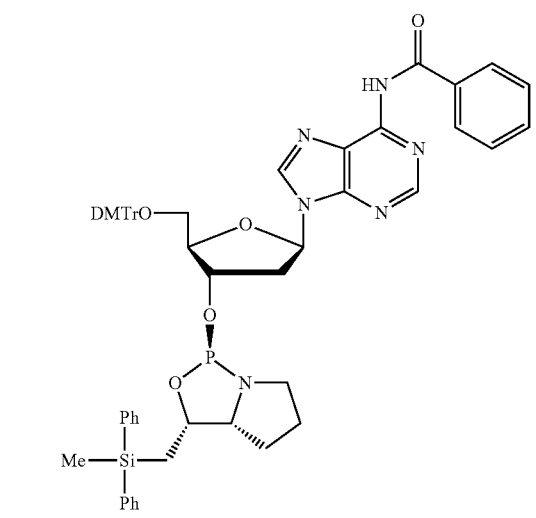
15b

195
-continued
16a
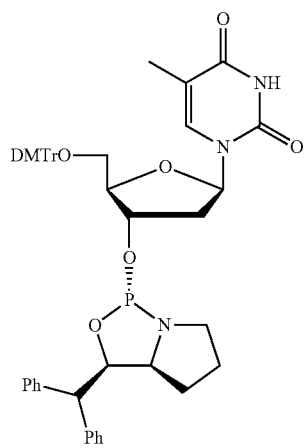
16b
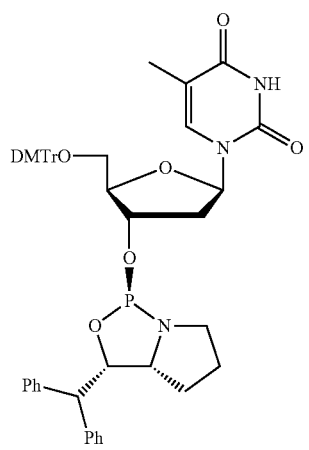
17a
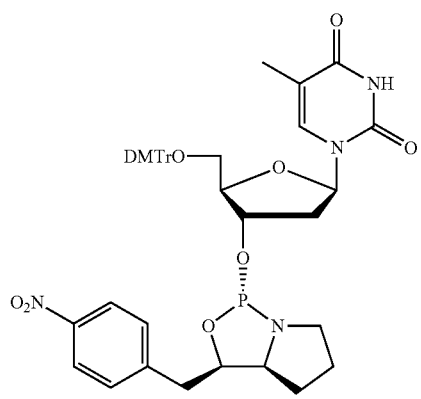
196
-continued
17b
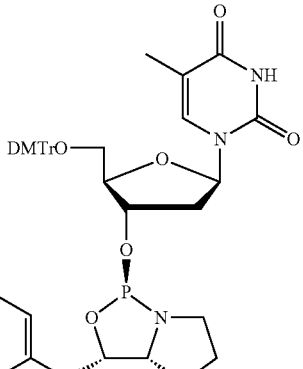
18a
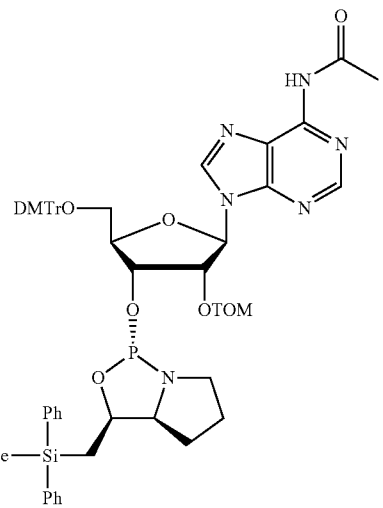
18b
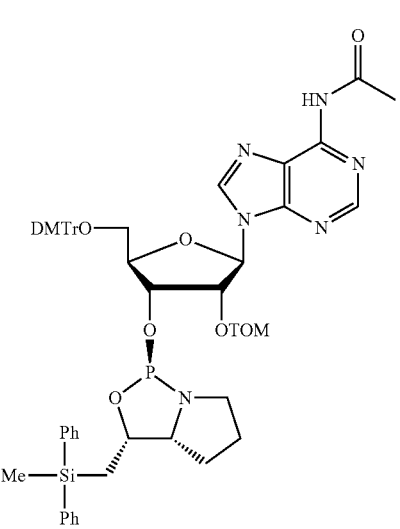

-continued
19a
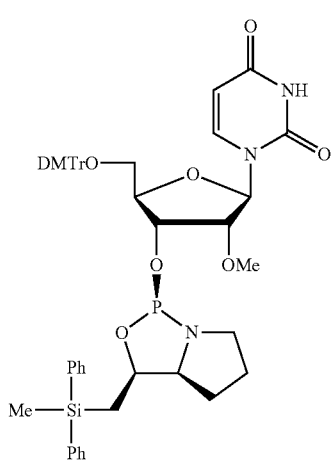
19b
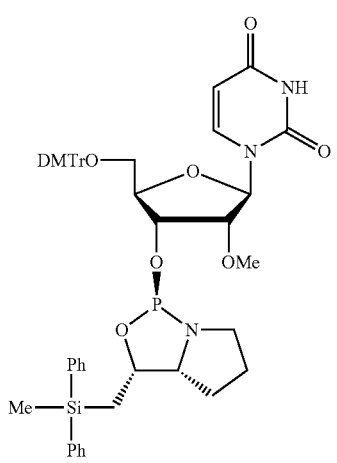
20a
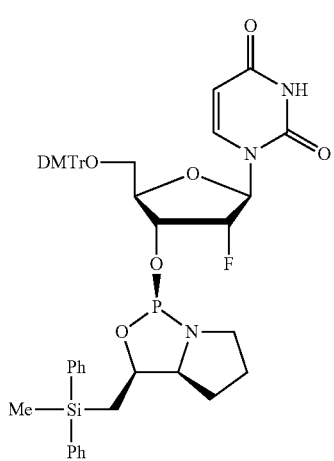
-continued
20b
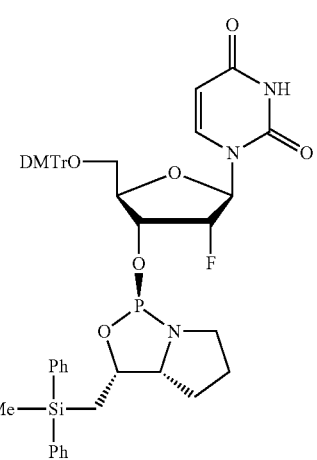
21a
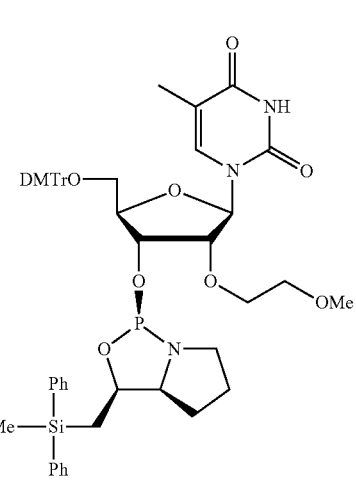
21b
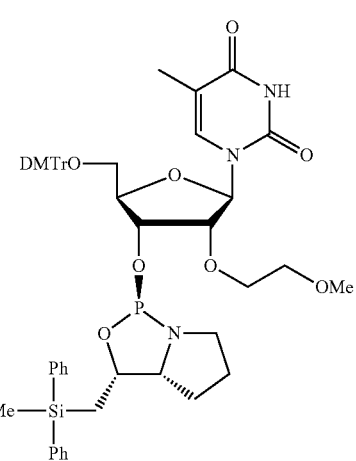

199
-continued
22a
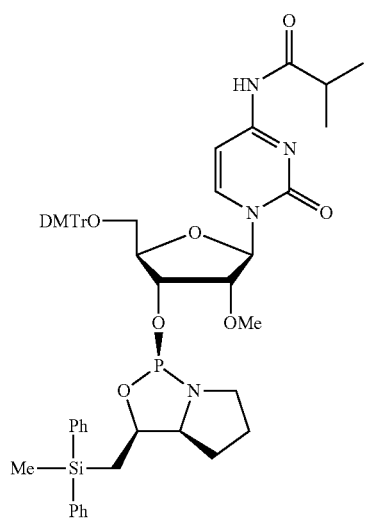
22b
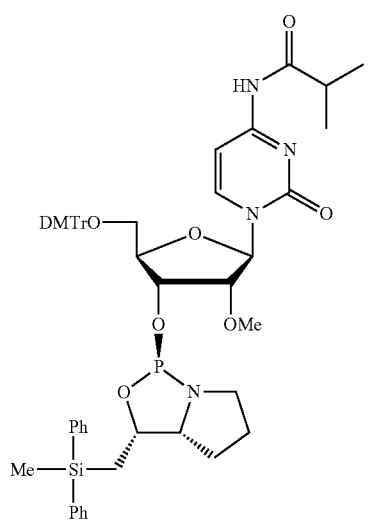
23a
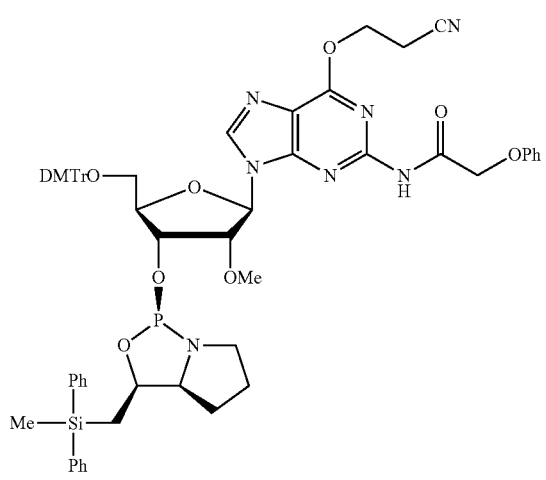
200
-continued
23b
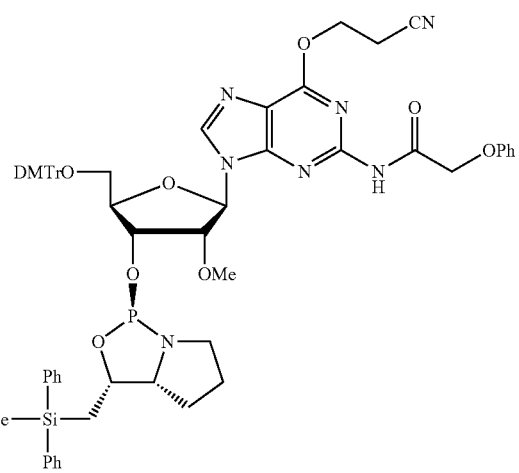
24a
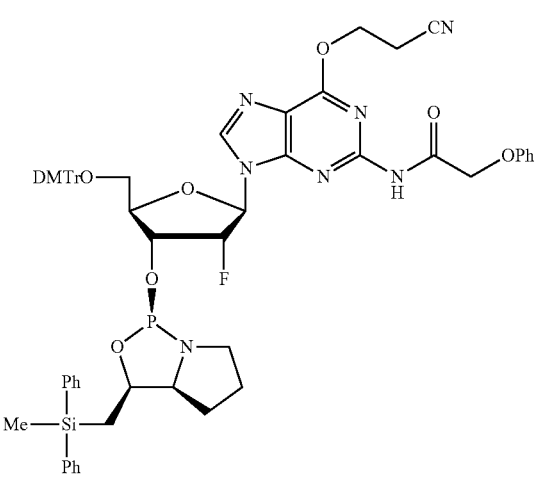
24b
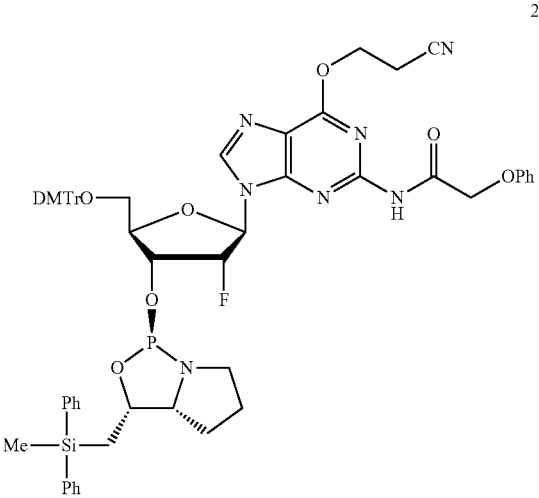

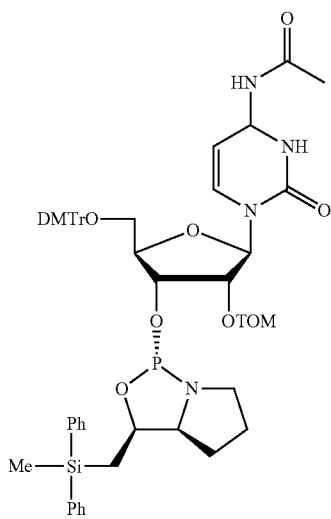
25a
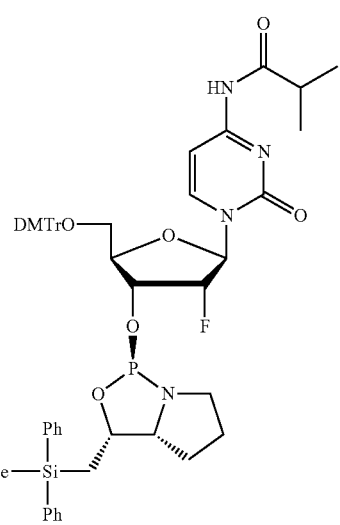
26b

25b

27a
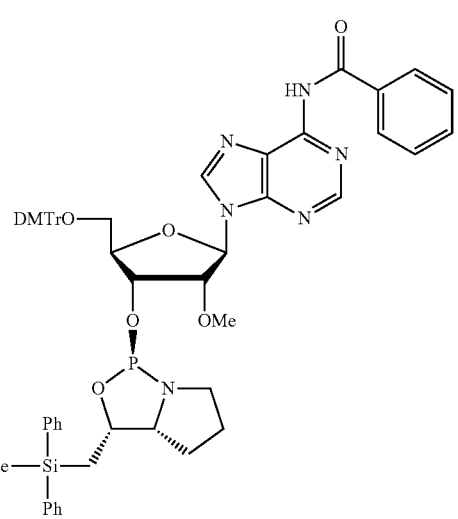
26a
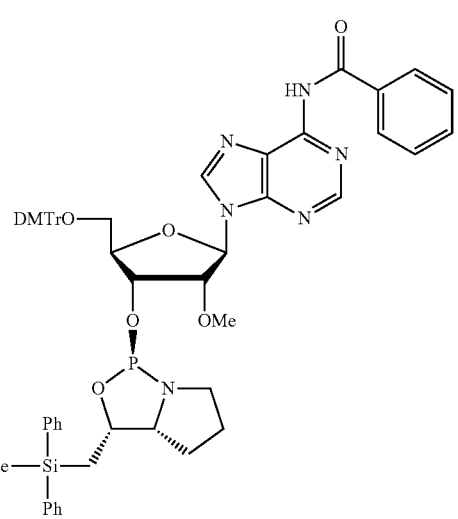
27b 203 -continued
28a
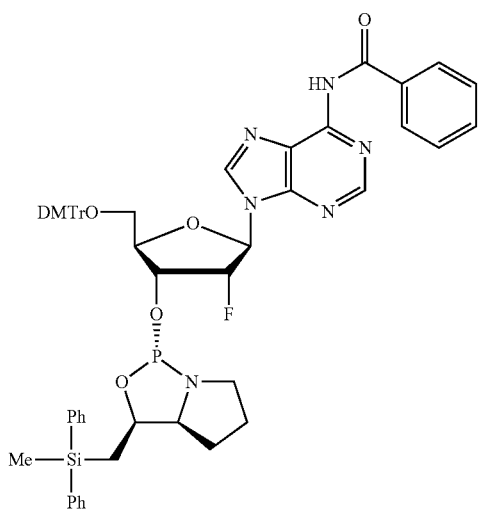
28b
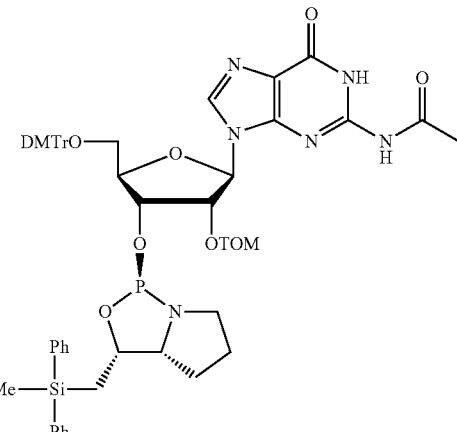
29a
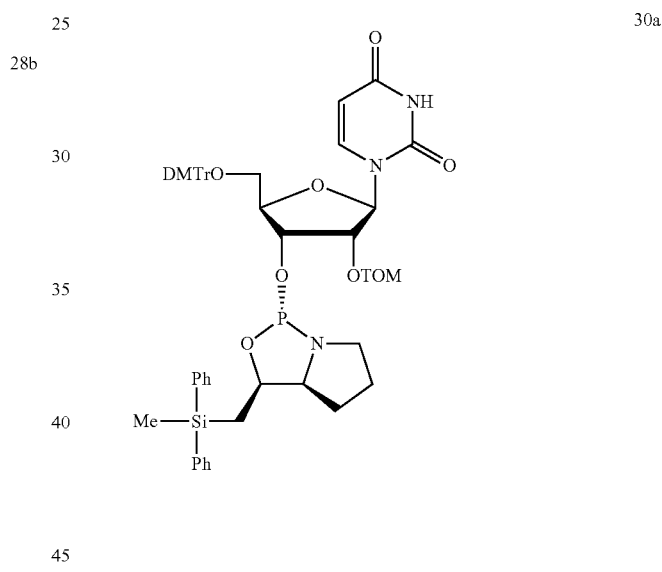
204 -continued
29b
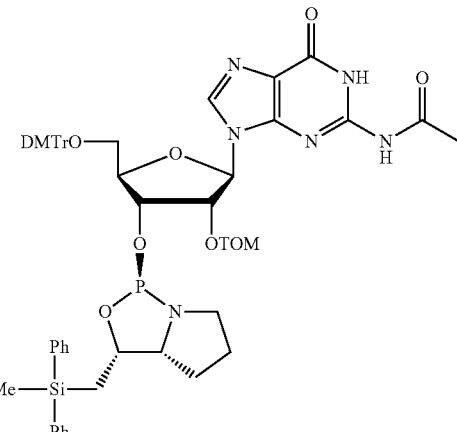
30a
30b
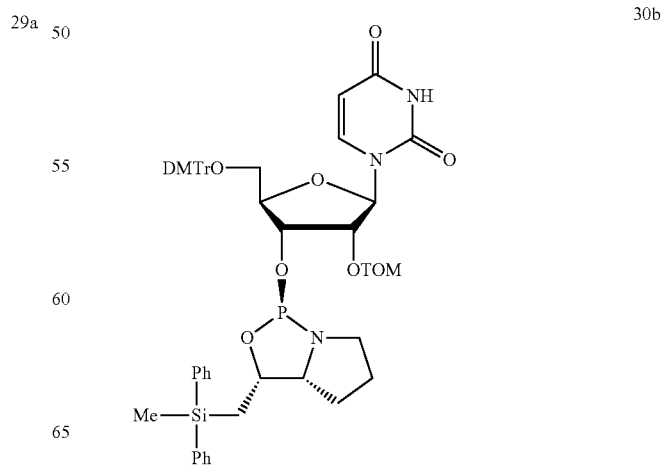

31a
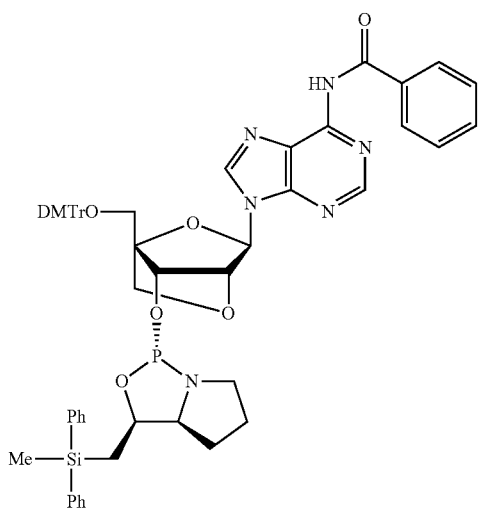
31b
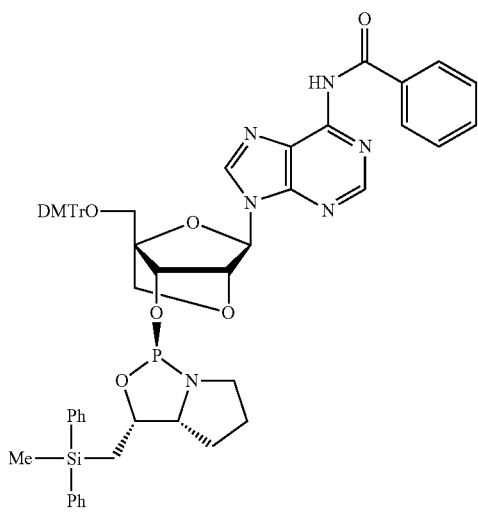
32a
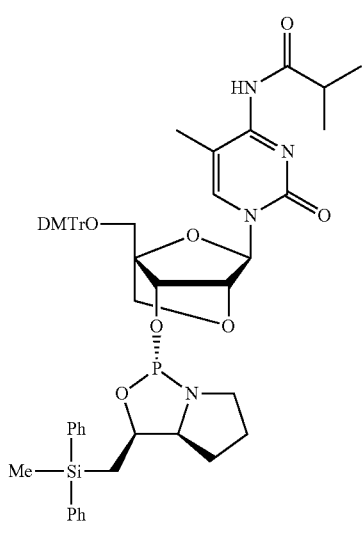
32b
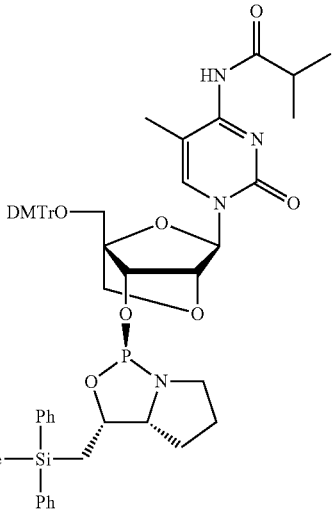
33a
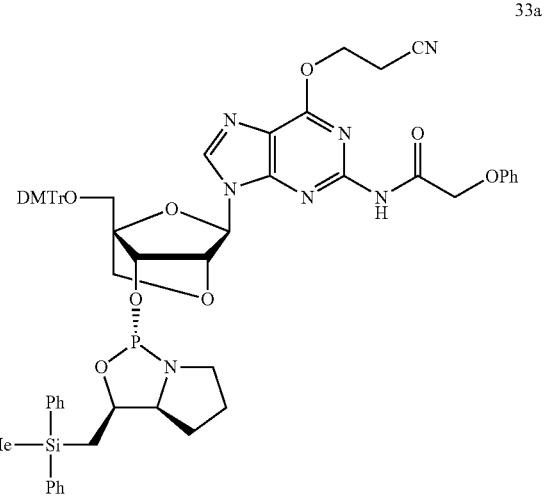
33b
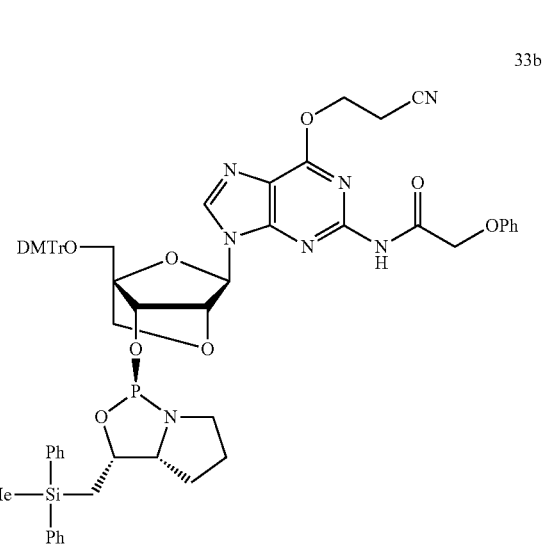

-continued

34a

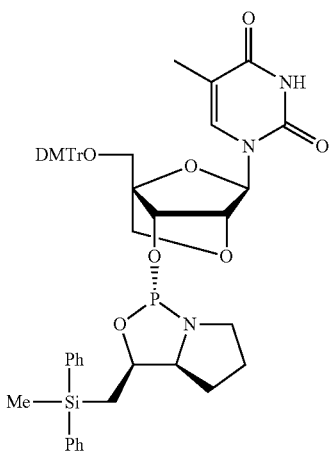

34b

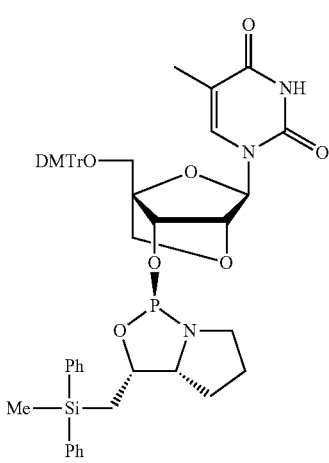

35a

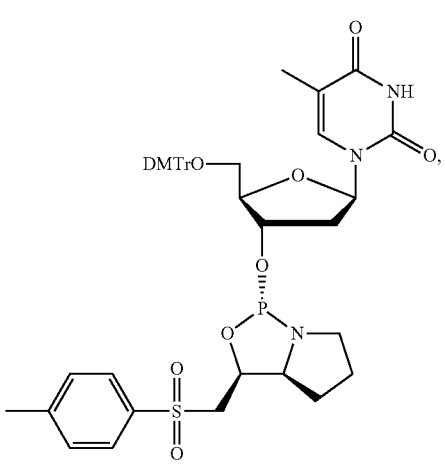

and

-continued

35a

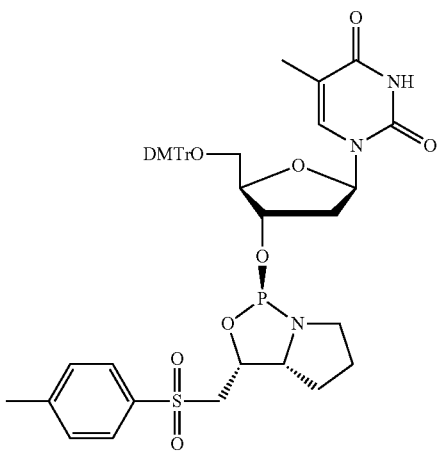

DMTr represents a 4,4'-dimethoxytrityl group and TOM represents a triisopropylsiloxymethyl group.

Examples using a nucleoside 3'-phosphoramidite derivative are disclosed in, e.g., JP 2005-89441 A. By repeating steps of condensation and de-protection, methods of the present invention facilitate lengthening the chain of oligonucleotide, as disclosed therein.

In some embodiments, an oligonucleotide is as shown in formula (Z-X):

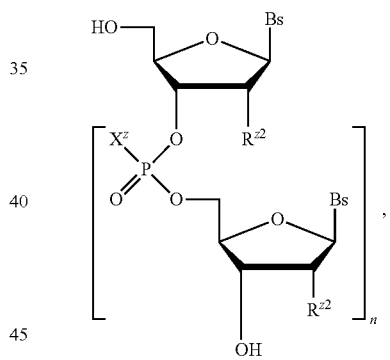

(Z-X)

wherein, in the formula (Z-X), $X^z$ represents sulfide (=S), $C_{1-3}$ alkyl, $C_{1-3}$ alkoxy, $C_{1-3}$ alkylthio, $C_6$-$C_{10}$ aryl, $C_6$-$C_{10}$ aralkyl, or $C_6$-$C_{10}$ aryloxialkyl. In some embodiments, $X^z$ represents sulfide (=S). $n^z$ is an integer that represents 1 to 150, 1 to 100, 1 to 50, or 1 to 30. In some embodiments, $n^z$ is preferably 2 to 100, preferably 10 to 100, preferably 10 to 50, and more preferably 15 to 30.

In some embodiments, the present invention provides methods for synthesis of a stereocontrolled phosphorus atom-modified oligonucleotide derivative. In some embodiments, the first step is a step of reacting a molecule comprising an achiral H-phosphonate moiety, the first activating reagent and a chiral reagent or a salt thereof to form a monomer. In some embodiments, the chiral reagent has chemical formula (Z-I) or (Z-I') and the monomer may be represented by formula (Z-Va), (Z-Vb), (Z-Va'), or (Z-Vb'). The monomer reacts with the second activating reagent and a nucleoside to form a condensed intermediate. Next step is a step of converting the condensed intermediate to the nucleic acid comprising a chiral X-phosphonate moiety. In some embodiments, the methods are as described in WO 2010/064146. In some embodiments, the steps are as described in route A and route B of WO 2010/064146.

In some embodiments, the present invention provides a method of synthesizing chirally controlled oligonucleotide as illustrated in Scheme Z-1 below.

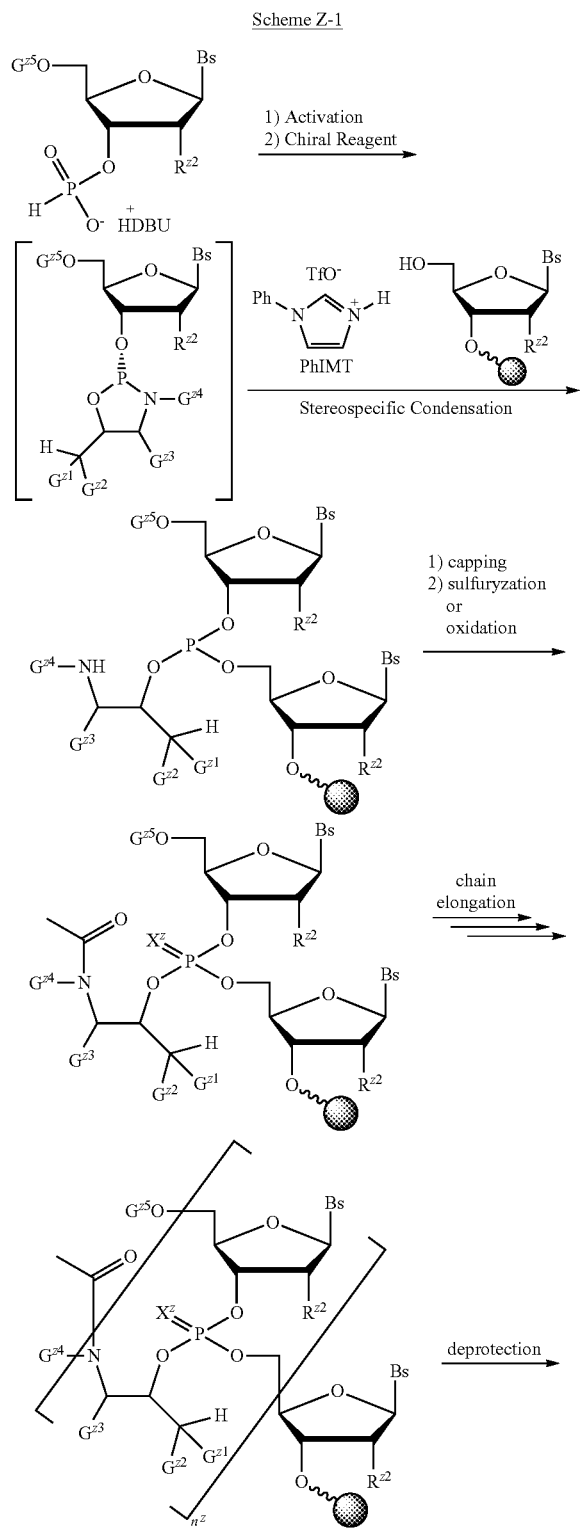

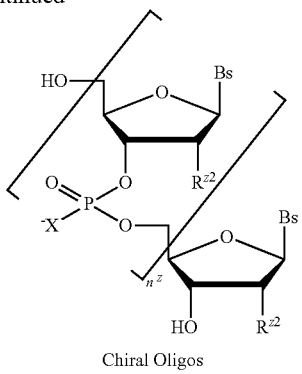

Chiral Oligos

Activation

An achiral H-phosphonate moiety is treated with the first activating reagent to form the first intermediate. In one embodiment, the first activating reagent is added to the reaction mixture during the condensation step. Use of the first activating reagent is dependent on reaction conditions such as solvents that are used for the reaction. Examples of the first activating reagent are phosgene, trichloromethyl chloroformate, bis(trichloromethyl)carbonate (BTC), oxalyl chloride, $Ph_3PCl_2$, $(PhO)_3PCl_2$, N,N'-bis(2-oxo-3-oxazolidinyl)phosphinic chloride (BopCl), 1,3-dimethyl-2-(3-nitro-1,2,4-triazol-1-yl)-2-pyrrolidin-1-yl-1,3,2-diazaphospholidinium hexafluorophosphate (MNTP), or 3-nitro-1,2,4-triazol-1-yl-tris(pyrrolidin-1-yl)phosphonium hexafluorophosphate (PyNTP).

The example of achiral H-phosphonate moiety is a compound shown in the above Scheme. DBU represents 1,8-diazabicyclo[5.4.0]undec-7-ene. HDBU may be, for example, ammonium ion, alkylammonium ion, heteroaromatic iminium ion, or heterocyclic iminium ion, any of which is primary, secondary, tertiary or quaternary, or a monovalent metal ion.

Reacting with Chiral Reagent

After the first activation step, the activated achiral H-phosphonate moiety reacts with a chiral reagent, which is represented by formula (Z-I) or (Z-I'), to form a chiral intermediate of formula (Z-Va), (Z-Vb), (Z-Va'), or (Z-Vb').

Stereospecific Condensation Step

A chiral intermediate of Formula Z-Va ((Z-Vb), (Z-Va'), or (Z-Vb')) is treated with the second activating reagent and a nucleoside to form a condensed intermediate. The nucleoside may be on solid support. Examples of the second activating reagent are 4,5-dicyanoimidazole (DCI), 4,5-dichloroimidazole, 1-phenylimidazolium triflate (PhIMT), benzimidazolium triflate (BIT), benztriazole, 3-nitro-1,2,4-triazole (NT), tetrazole, 5-ethylthiotetrazole (ETT), 5-benzylthiotetrazole (BTT), 5-(4-nitrophenyl)tetrazole, N-cyanomethylpyrrolidinium triflate (CMPT), N-cyanomethylpiperidinium triflate, N-cyanomethyldimethylammonium triflate. A chiral intermediate of Formula Z-Va ((Z-Vb), (Z-Va'), or (Z-Vb')) may be isolated as a monomer. Usually, the chiral intermediate of Z-Va ((Z-Vb), (Z-Va'), or (Z-Vb')) is not isolated and undergoes a reaction in the same pot with a nucleoside or modified nucleoside to provide a chiral phosphite compound, a condensed intermediate. In other embodiments, when the method is performed via solid phase synthesis, the solid support comprising the compound is filtered away from side products, impurities, and/or reagents.

Capping Step

If the final nucleic acid is larger than a dimer, the unreacted —OH moiety is capped with a blocking group and the chiral auxiliary in the compound may also be capped with a blocking group to form a capped condensed intermediate. If the final nucleic acid is a dimer, then the capping step is not necessary.

Modifying Step

The compound is modified by reaction with an electrophile. The capped condensed intermediate may be executed modifying step. In some embodiments, the modifying step is performed using a sulfur electrophile, a selenium electrophile or a boronating agent. Examples of modifying steps are step of oxidation and sulfurization.

In some embodiments of the method, the sulfur electrophile is a compound having one of the following formulas:

$S_8$ (Formula Z-B), $Z^{z1}$—S—S—$Z^{z2}$, or $Z^{z1}$—S—$V^z$—$Z^{z2}$;

wherein $Z^{z1}$ and $Z^{z2}$ are independently alkyl, aminoalkyl, cycloalkyl, heterocyclic, cycloalkylalkyl, heterocycloalkyl, aryl, heteroaryl, alkyloxy, aryloxy, heteroaryloxy, acyl, amide, imide, or thiocarbonyl, or $Z^{z1}$ and $Z^{z2}$ are taken together to form a 3 to 8 membered alicyclic or heterocyclic ring, which may be substituted or unsubstituted; $V^z$ is $SO_2$, O, or $NR^f$; and $R^f$ is hydrogen, alkyl, alkenyl, alkynyl, or aryl.

In some embodiments of the method, the sulfur electrophile is a compound of following Formulae Z-A, Z-B, Z-C, Z-D, Z-E, or Z-F:

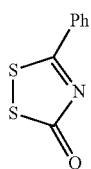

Formula Z-A $S_8$

Formula Z-B

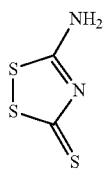

Formula Z-C

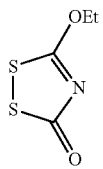

Formula Z-D

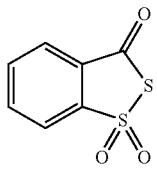

Formula Z-E

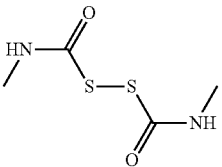

Formula Z-F

In some embodiments, the selenium electrophile is a compound having one of the following formulae:

Se (Formula Z-G), $Z^{z3}$—Se—Se—$Z^{z4}$, or $Z^{z3}$—Se—$V^z$—$Z^{z4}$;

wherein $Z^{z3}$ and $Z^{z4}$ are independently alkyl, aminoalkyl, cycloalkyl, heterocyclic, cycloalkylalkyl, heterocycloalkyl, aryl, heteroaryl, alkyloxy, aryloxy, heteroaryloxy, acyl, amide, imide, or thiocarbonyl, or $Z^{z3}$ and $Z^{z4}$ are taken together to form a 3 to 8 membered alicyclic or heterocyclic ring, which may be substituted or unsubstituted; $V^z$ is $SO_2$, S, O, or $NR^f$; and $R^f$ is hydrogen, alkyl, alkenyl, alkynyl, or aryl.

In some embodiments, the selenium electrophile is a compound of Formula Z-G, Z-H, Z-I, Z-J, Z-K, or Z-L.

Se                                                       Formula Z-G

KSeCN                                                    Formula Z-H

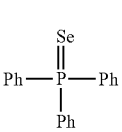

Formula Z-I

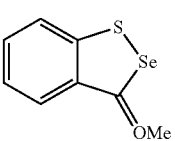

Formula Z-J

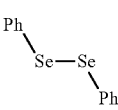

Formula Z-K

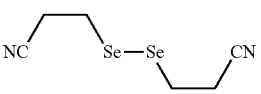

Formula Z-L

In some embodiments, the boronating agent is borane-N,N-diisopropylethylamine ($BH_3$ DIPEA), borane-pyridine ($BH_3$ Py), borane-2-chloropyridine ($BH_3$ CPy), borane-aniline ($BH_3$ An), borane-tetrahydrofiirane ($BH_3$ THF), or borane-dimethylsulfide ($BH_3$ $Me_2S$).

In some embodiments of the method, the modifying step is an oxidation step. In some embodiments of the method, the modifying step is an oxidation step using similar conditions as described above in this application. In some embodiments, an oxidation step is as disclosed in, e.g., JP 2010-265304 A and WO2010/064146.

Chain Elongation Cycle and De-Protection Step

The capped condensed intermediate is deblocked to remove the blocking group at the 5'-end of the growing nucleic acid chain to provide a compound. The compound is optionally allowed to re-enter the chain elongation cycle to form a condensed intermediate, a capped condensed intermediate, a modified capped condensed intermediate, and a 5'-deprotected modified capped intermediate. Following at least one round of chain elongation cycle, the 5'-deprotected modified capped intermediate is further deblocked by removal of the chiral auxiliary ligand and other protecting groups for, e.g., nucleobase, modified nucleobase, sugar and modified sugar protecting groups, to provide a nucleic acid. In other embodiments, the nucleoside comprising a 5'-OH moiety is an intermediate from a previous chain elongation cycle as described herein. In yet other embodiments, the nucleoside comprising a 5'-OH moiety is an intermediate obtained from another known nucleic acid synthetic method. In embodiments where a solid support is used, the phosphorus-atom modified nucleic acid is then cleaved from the solid support. In certain embodiments, the nucleic acids is left attached on the solid support for purification purposes and then cleaved from the solid support following purification.

In yet other embodiments, the nucleoside comprising a 5'-OH moiety is an intermediate obtained from another known nucleic acid synthetic method. In yet other embodiments, the nucleoside comprising a 5'-OH moiety is an intermediate obtained from another known nucleic acid synthetic method as described in this application. In yet other embodiments, the nucleoside comprising a 5'-OH moiety is an intermediate obtained from another known nucleic acid synthetic method comprising one or more cycles illustrated in Scheme I. In yet other embodiments, the nucleoside comprising a 5'-OH moiety is an intermediate obtained from another known nucleic acid synthetic method comprising one or more cycles illustrated in Scheme I-b, I-c or I-d.

In some embodiments, the present invention provides oligonucleotide synthesis methods that use stable and commercially available materials as starting materials. In some embodiments, the present invention provides oligonucleotide synthesis methods to produce stereocontrolled phosphorus atom-modified oligonucleotide derivatives using an achiral starting material.

In some embodiments, the method of the present invention does not cause degradations under the de-protection steps. Further the method does not require special capping agents to produce phosphorus atom-modified oligonucleotide derivatives.

In some embodiments, the present invention provides methods for the synthesis of stereocontrolled phosphorus atom-modified oligonucleotide derivatives using a chiral monomer. In some embodiments, the first step is reacting a nucleoside 3'-phosphoramidite derivative which is represented by formula (Z-Va), (Z-Vb), (Z-Va'), or (Z-Vb') with the second activating reagent and a nucleoside to form a condensed intermediate. The second step is converting the condensed intermediate to the nucleic acid comprising a chiral X-phosphonate moiety. An exemplary method is illustrated Scheme Z-2 below.

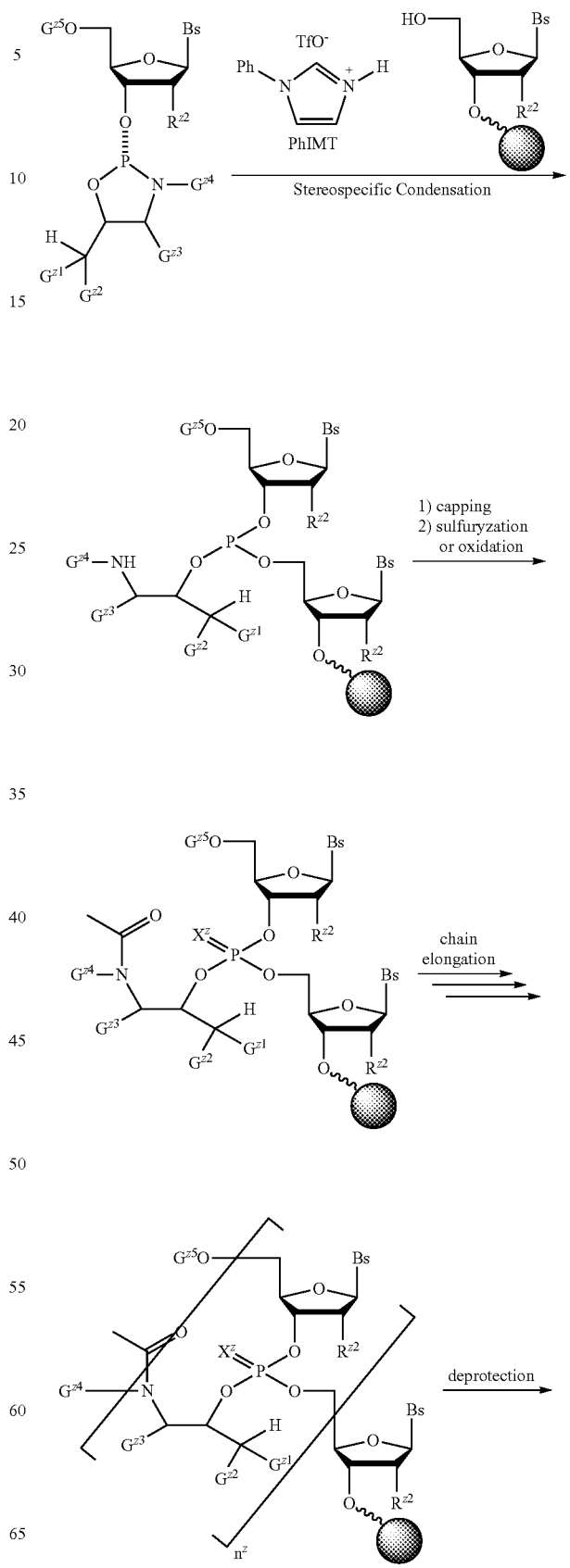

Scheme Z-2

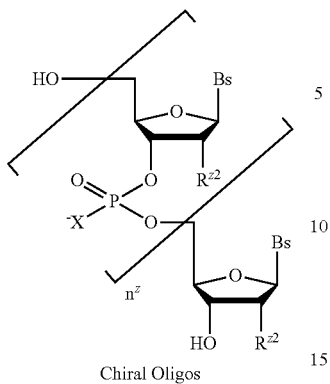

Chiral Oligos

The detailed conditions of the Scheme Z-2 are similar to that of Scheme Z-1. The starting material of formula Z-Va (Z-Vb), especially of formula Z-Va' (or Z-Vb'), is chemically stable. As shown in a working example, the method of the present invention does not cause degradations under the de-protection steps. Further the method does not require special capping agents to produce phosphorus atom-modified oligonucleotide derivatives.

In some embodiments, mechanism for the removal of auxiliaries is shown as illustrated in Scheme Z-3, below.

Scheme Z-3.

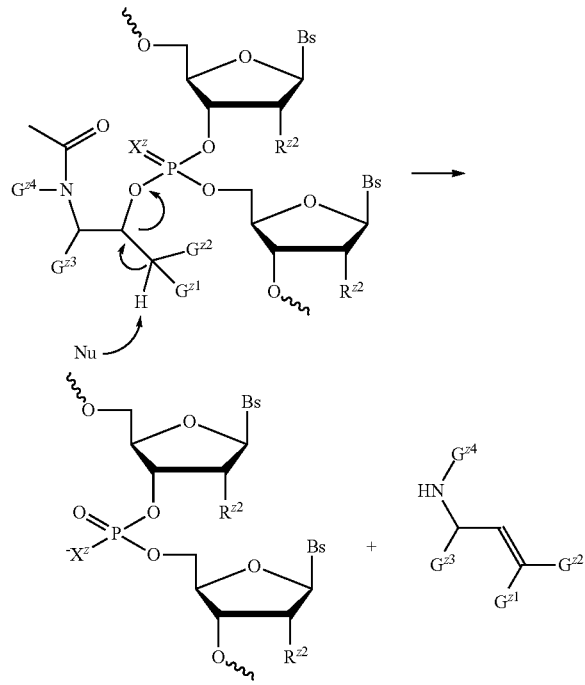

In Scheme Z-3, Nu stands for is a nucleophile. In some embodiments, the mechanism in Scheme Z-3 is thought to be different from the previous mechanism for the removal of auxiliaries.

In some embodiments, the present invention provides a chiral reagent or a salt thereof, the chiral reagent having following chemical formula (Z-I):

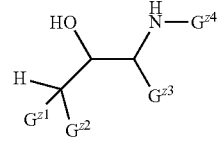
(Z-I)

wherein $G^{z1}$ and $G^z$ are independently a hydrogen atom, a nitro group, a halogen atom, a cyano group, a group of formula (Z-II) or (Z-III), or both $G^{z1}$ and $G^{z2}$ taken together to form a group of formula (Z-IV),

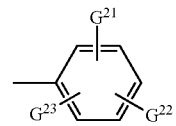
(Z-II)

wherein $G^{21}$ to $G^{23}$ are independently a hydrogen atom, a nitro group, a halogen atom, a cyano group or $C_{1-3}$ alkyl group,

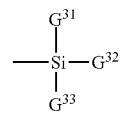
(Z-III)

wherein $G^{31}$ to $G^{33}$ are independently $C_{1-4}$ alkyl group, $C_{1-4}$ alkoxy group, $C_{6-14}$ aryl group, $C_{7-14}$ aralkyl group, $C_{1-4}$ alkyl $C_{6-14}$ aryl group, $C_{1-4}$ alkoxy $C_{6-14}$ aryl group, or $C_{6-14}$ aryl $C_{1-4}$ alkyl group,

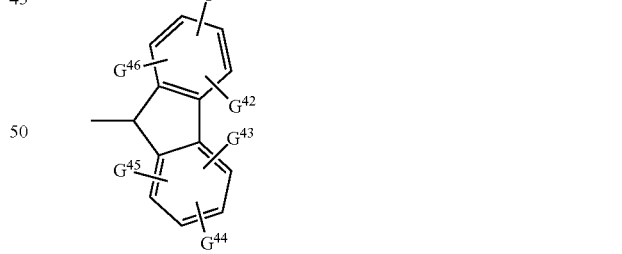
(Z-IV)

wherein $G^{41}$ to $G^{46}$ are independently a hydrogen atom, a nitro group, a halogen atom, a cyano group or $C_{1-3}$ alkyl group, $G^{z3}$ and $G^{z4}$ are independently a hydrogen atom, $C_{1-3}$ alkyl group, $C_{6-14}$ aryl group, or both $G^{z3}$ and $G^{z4}$ taken together to form a heteroatom-containing ring that has 3 to 16 carbon atoms.

In some embodiments, the present invention provides a chiral reagent, or a salt thereof, of formula Z-1 has following chemical formula (Z-I')

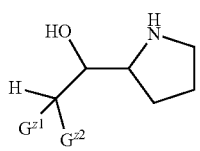

(Z-1')

wherein each variable is independently as defined above and described herein. In some embodiments, the present invention provides a chiral reagent, or a salt thereof, of formula (Z-1'), wherein each of $G^{z1}$ and $G^{z2}$ is a group of formula (Z-II), wherein $G^{21}$ to $G^{23}$ are independently a hydrogen atom, a nitro group, a halogen atom, a cyano group or $C_{1-3}$ alkyl group. In some embodiments, the present invention provides a chiral reagent, or a salt thereof, of formula (Z-1'), wherein each of $G^{z1}$ and $G^{z2}$ is a group of formula (Z-II), wherein each of $G^{21}$ to $G^{23}$ is a hydrogen atom. In some embodiments, the present invention provides a chiral reagent, or a salt thereof, of formula (Z-1'), wherein $G^{z1}$ is a hydrogen atom, and $G^{z2}$ is a group of formula (Z-II), wherein $G^{21}$ to $G^{23}$ are independently a hydrogen atom, a nitro group, a halogen atom, a cyano group or $C_{1-3}$ alkyl group. In some embodiments, the present invention provides a chiral reagent, or a salt thereof, of formula (Z-1'), wherein $G^{z1}$ is a hydrogen atom, and $G^{z2}$ is a group of formula (Z-II), wherein each of $G^{21}$ and $G^{22}$ is a hydrogen atom and $G^{23}$ is a nitro group. In some embodiments, the present invention provides a chiral reagent, or a salt thereof, of formula (Z-1'), wherein $G^{z1}$ is a hydrogen atom, and $G^{z2}$ is a group of formula (Z-III), wherein $G^{31}$ to $G^{33}$ are independently $C_{1-4}$ alkyl group, $C_{6-14}$ aryl group, $C_{7-14}$ aralkyl group, $C_{1-4}$ alkyl $C_{6-14}$ aryl group, $C_{1-4}$ alkoxy $C_{6-14}$ aryl group, or $C_{6-14}$ aryl $C_{1-4}$ alkyl group. In some embodiments, the present invention provides a chiral reagent, or a salt thereof, of formula (Z-1'), wherein $G^{z1}$ is a hydrogen atom, and $G^{z2}$ is a group of formula (Z-III), wherein $G^{31}$ to $G^{33}$ are independently $C_{1-4}$ alkyl group, $C_6$ aryl group, $C_{7-10}$ aralkyl group, $C_{1-4}$ alkyl $C_6$ aryl group, $C_{1-4}$ alkoxy $C_6$ aryl group, or $C_6$ aryl $C_{1-4}$ alkyl group. In some embodiments, the present invention provides a chiral reagent, or a salt thereof, of formula (Z-1'), wherein $G^{z1}$ is a hydrogen atom, and $G^{z2}$ is a group of formula (Z-III), wherein $G^3$ to $G^{33}$ are independently $C_{1-4}$ alkyl group, or $C_6$ aryl group. In some embodiments, the present invention provides a chiral reagent, or a salt thereof, of formula (Z-1'), wherein $G^{z1}$ is a hydrogen atom, and $G^{z2}$ is a group of formula (Z-III), wherein $G^{31}$ and $G^{33}$ are $C_6$ aryl group and $G^{32}$ is $C_{1-2}$ alkyl group. In some embodiments, the present invention provides a chiral reagent, or a salt thereof, of formula (Z-1'), wherein $G^{z1}$ is a hydrogen atom, and $G^{z2}$ is a group of formula (Z-III), wherein $G^{31}$ to $G^{33}$ are independently $C_{1-4}$ alkyl group. In some embodiments, the present invention provides a chiral reagent, or a salt thereof, of formula (Z-1'), wherein $G^{z1}$ is a hydrogen atom, and $G^{z2}$ is a group of formula (Z-III), wherein $G^{31}$ and $G^{33}$ are $C_6$ aryl group and $G^{32}$ is $C_{1-4}$ alkyl group. In some embodiments, the present invention provides a chiral reagent, or a salt thereof, of formula (Z-1'), wherein $G^{z1}$ is a hydrogen atom, and $G^{z2}$ is a group of formula (Z-IV), wherein $G^{41}$ to $G^{46}$ are independently a hydrogen atom, a nitro group, a halogen atom, a cyano group or $C_{1-3}$ alkyl group. In some embodiments, the present invention provides a chiral reagent, or a salt thereof, of formula (Z-1'), wherein $G^{z1}$ and $G^{z2}$ are taken together to form a group of formula (Z-IV), wherein $G^{41}$ to $G^{46}$ are independently a hydrogen atom, a nitro group, a halogen atom, a cyano group or $C_{1-3}$ alkyl group. In some embodiments, the present invention provides a chiral reagent, or a salt thereof, of formula (Z-1'), wherein $G^{z1}$ and $G^{z2}$ are taken together to form a group of formula (Z-IV), wherein each of $G^{41}$ to $G^{46}$ is a hydrogen atom.

In some embodiments, a chiral reagent or a salt thereof is selected from formulae 3a, 3b, 5a, Z-5b, 7a, 7b, 9a, 9b, 11a and 11b.

In some embodiments, the present invention provides a nucleoside 3'-phosphoramidite derivative which is represented by formula Z-Va or Z-Vb:

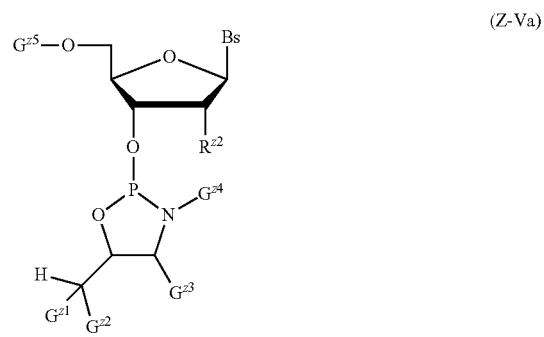

(Z-Va)

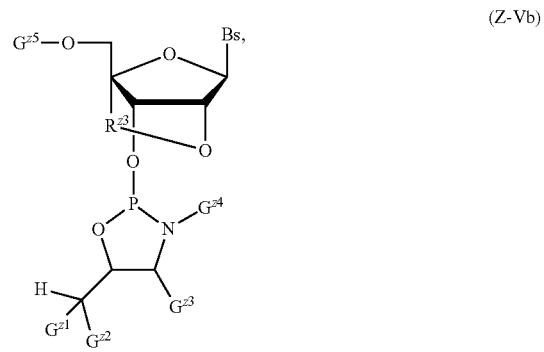

(Z-Vb)

wherein $G^{z1}$ and $G^{z2}$ are independently a hydrogen atom, a nitro group, a halogen atom, a cyano group, a group of formula (Z-II) or (Z-III), or both $G^{z1}$ and $G^{z2}$ taken together to form a group of formula (Z-IV),

(Z-II)

wherein $G^{21}$ to $G^{23}$ are independently a hydrogen atom, a nitro group, a halogen atom, a cyano group or $C_{1-3}$ alkyl group,

(Z-III)

wherein $G^{31}$ to $G^{33}$ are independently $C_{1-4}$ alkyl group, $C_{1-4}$ alkoxy group, $C_{6-14}$ aryl group, $C_{7-14}$ aralkyl group, $C_{1-4}$ alkyl $C_{6-14}$ aryl group, $C_{1-4}$ alkoxy $C_{6-14}$ aryl group, or $C_{6-14}$ aryl $C_{1-4}$ alkyl group,

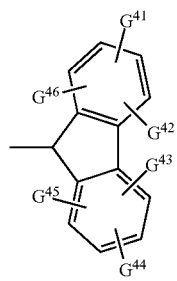

(Z-IV)

wherein $G^{41}$ to $G^{46}$ are independently a hydrogen atom, a nitro group, a halogen atom, a cyano group or $C_{1-3}$ alkyl group;

$G^{z3}$ and $G^4$ are independently a hydrogen atom, $C_{1-3}$ alkyl group, $C_{6-14}$ aryl group, or both $G^{z3}$ and $G^{z4}$ taken together to form a heteroatom-containing ring that has 3 to 16 carbon atoms;

$G^{z5}$ is a protective group of a hydroxyl group;

$R^{z2}$ is independently hydrogen, —OH, —SH, —NR$^d$R$^d$, —N$_3$, halogen, alkyl, alkenyl, alkynyl, alkyl-Y$^1$—, alkenyl-Y$^1$—, alkynyl-Y$^1$—, aryl-Y$^1$—, heteroaryl-Y$^1$—, —OR$^b$, or —SR$^b$, wherein R$^b$ is a blocking moiety;

$Y^1$ is O, NR$^d$, S, or Se;

$R^d$ is independently hydrogen, alkyl, alkenyl, alkynyl, aryl, acyl, substituted silyl, carbamate, —P(O)(R$^e$)$_2$, or —HP(O)(R$^e$);

$R^e$ is independently hydrogen, alkyl, aryl, alkenyl, alkynyl, alkyl-Y$^2$—, alkenyl-Y$^2$—, alkynyl-Y$^2$—, aryl-Y$^2$—, or heteroaryl-Y$^2$—, or a cation which is Na$^+$, Li$^+$, or K$^+$, or —O$^-$;

$Y^2$ is O, NR$^d$, or S;

$R^{z3}$ is a group represented by —CH$_2$—, —(CH$_2$)$_2$—, —CH$_2$NH—, or —CH$_2$N(CH$_3$)—; and Bs is a group selected from the groups represented by following formula (Z-VI) to (Z-XI) or derivatives thereof.

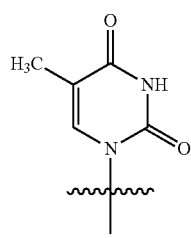

(Z-VI)

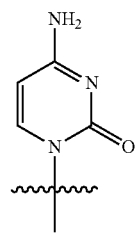

(Z-VII)

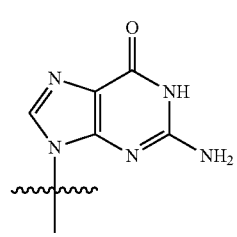

(Z-VIII)

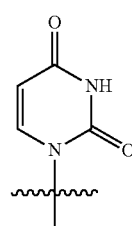

(Z-IX)

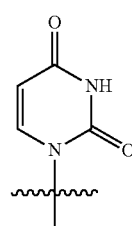

(Z-X)

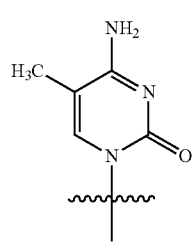

(Z-XI)

In some embodiments, the present invention provides a nucleoside 3'-phosphoramidite derivative of formula Z-Va or Z-Vb, having the structure of (Z-Va') or (Z-Vb'):

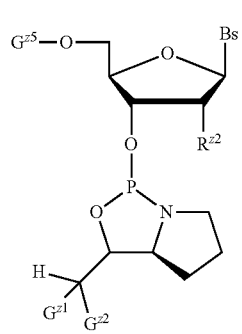

(Z-Va')

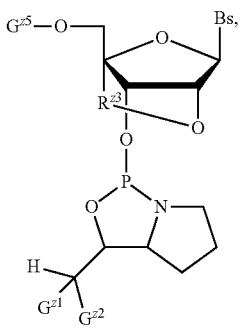

(Z-Vb')

wherein each variable is independently as defined above and described herein.

In some embodiments, the present invention provides a nucleoside 3'-phosphoramidite derivative selected from formulae 12a, 12b, 13a, 13b, 14a, 14b, 15a, 15b, 16a, 16b, 17a, 17b, 18a, 18b, 19a, 19b, 20a, 20b, 21a, 21b, 22a, 22b, 23a, 23b, 24a, 24b, 25a, 25b, 26a, 26b, 27a, 27b, 28a, 28b, 29a, 29b, 30a, 30b, 31a, 31b, 32a, 32b, 33a, 33b, 34a, 34b and 35a. In some embodiments, the present invention provides a nucleoside 3'-phosphoramidite derivative selected from formulae 12a, 12b, 13a, 13b, 14a, 14b, 15a, 15b, 16a, 16b, 17a, 17b, 18a, 18b, 19a, 19b, 20a, 20b, 21a, 21b, 22a, 22b, 23a, 23b, 24a, 24b, 25a, 25b, 26a, or 26b.

In some embodiments, the present invention provides a method for synthesis of stereocontrolled phosphorus atom-modified oligonucleotide derivatives comprising steps of: reacting a molecule comprising an achiral H-phosphonate moiety, a chiral reagent or a salt thereof to form a monomer of a nucleoside 3'-phosphoramidite derivative; reacting the monomer and a nucleoside to form a condensed intermediate; and converting the condensed intermediate to the nucleic acid comprising a chiral X-phosphonate moiety; wherein the chiral reagent has following chemical formula (Z-I).

In some embodiments, the present invention provides a method for synthesis of stereocontrolled phosphorus atom-modified oligonucleotide derivatives comprising steps of: reacting a molecule comprising an achiral H-phosphonate moiety, a chiral reagent or a salt thereof to form a monomer of a nucleoside 3'-phosphoramidite derivative; reacting the monomer and a nucleoside to form a condensed intermediate; and converting the condensed intermediate to the nucleic acid comprising a chiral X-phosphonate moiety; wherein the chiral reagent has following chemical formula (Z-I').

In some embodiments, the present invention provides a method for synthesis of stereocontrolled phosphorus atom-modified oligonucleotide derivatives comprising steps of: reacting a molecule comprising an achiral H-phosphonate moiety, a chiral reagent or a salt thereof to form a monomer of a nucleoside 3'-phosphoramidite derivative;
reacting the monomer and a nucleoside to form a condensed intermediate; and
converting the condensed intermediate to the nucleic acid comprising a chiral X-phosphonate moiety;
wherein the chiral reagent is selected from formulae 3a, 3b, 5a, Z-5b, 7a, 7b, 9a, 9b, 11a and 11b.

In some embodiments, the present invention provides a method for synthesis of stereocontrolled phosphorus atom-modified oligonucleotide derivatives comprising steps of: reacting a nucleoside 3'-phosphoramidite derivative which is represented by formula (Z-Va) or (Z-Vb), with an activating reagent and a nucleoside to form a condensed intermediate; and converting the condensed intermediate to the nucleic acid comprising a chiral X-phosphonate moiety.

In some embodiments, the present invention provides a method for synthesis of stereocontrolled phosphorus atom-modified oligonucleotide derivatives comprising steps of: reacting a nucleoside 3'-phosphoramidite derivative represented by formula (Z-Va) or (Z-Vb), with an activating reagent and a nucleoside to form a condensed intermediate; and converting the condensed intermediate to the nucleic acid comprising a chiral X-phosphonate moiety; and wherein the nucleoside 3'-phosphoramidite derivative represented by formula (Z-Va) or (Z-Vb) is selected from formulae 12a, 12b, 13a, 13b, 14a, 14b, 15a, 15b, 16a, 16b, 17a, 17b, 18a, 18b, 19a, 19b, 20a, 20b, 21a, 21b, 22a, 22b, 23a, 23b, 24a, 24b, 25a, 25b, 26a, 26b, 27a, 27b, 28a, 28b, 29a, 29b, 30a, 30b, 31a, 31b, 32a, 32b, 33a, 33b, 34a, 34b and 35a. In some embodiments, the present invention provides a method for synthesis of stereocontrolled phosphorus atom-modified oligonucleotide derivatives comprising steps of:
reacting a nucleoside 3'-phosphoramidite derivative represented by formula (Z-Va) or (Z-Vb), with an activating reagent and a nucleoside to form a condensed intermediate; and converting the condensed intermediate to the nucleic acid comprising a chiral X-phosphonate moiety; and wherein the nucleoside 3'-phosphoramidite derivative represented by formula (Z-Va) or (Z-Vb) is selected from formulae 12a, 12b, 13a, 13b, 14a, 14b, 15a, 15b, 16a, 16b, 17a, 17b, 18a, 18b, 19a, 19b, 20a, 20b, 21a, 21b, 22a, 22b, 23a, 23b, 24a, 24b, 25a, 25b, 26a, and 26b.

Preparation and Use of Certain Chiral Auxiliaries of Formula Z-I

ABBREVIATION ac: acetyl
bz: benzoyl
CSO: (1S)-(+)-(10-camphorsulfonyl)oxaziridine
DBU: 1,8-diazabicyclo[5.4.0]undec-7-ene
DCA: dichloroacetic acid
DCM: dichloromethane, $CH_2Cl_2$
Tr: trityl, triphenylmethyl
MeIm: N-methylimidazole
NIS: N-iodosuccinimide
pac: phenoxyacetyl
Ph: phenyl
PhIMT: N-phenylimidazolium triflate
POS: 3-phenyl-1,2,4-dithiazoline-5-one
TBS: tert-butyldimethylsilyl
TBDPS: tert-butyldiphenylsilyl
TOM: trii sopropylsiloxymethyl
TFA: trifluoroacetic acid General Procedure for the Synthesis of Chirally Controlled Oligonucleotides—1.

The automated solid-phase synthesis of chirally controlled oligonucleotides was performed according to the cycles shown in Table Z-1.

TABLE Z-1

Synthesis procedure.

| step | operation | reagents and solvent | volume | waiting time |
|---|---|---|---|---|
| 1 | detritylation | 3% DCA/DCM | 1.6 mL | 20 s |
| 2 | coupling | 0.1M monomer/MeCN + 1M PhIMT | 0.5 mL | 5 min |
| 3 | capping | $Ac_2O$/THF-pyridine + 16% MeIm/THF | 0.5 mL | 30 s |
| 4 | oxidation/sulfurization | 0.5M CSO/MeCN or 0.1M POS/MeCN | 0.5 mL | 90 s |

General Procedure for the Synthesis of Chirally Controlled Oligonucleotides—2.

The automated solid-phase synthesis of chirally controlled oligonucleotides was performed according to the cycles shown in Table Z-2.

TABLE Z-2

| step | operation | reagents and solvent | volume | waiting time |
|---|---|---|---|---|
| 1 | detritylation | 3% DCA/DCM | 1.6 mL | 20 s |
| 2 | coupling | pre-activated monomer* + 1M phIMT | 0.5 mL | 5 min |
| 3 | capping | $Ac_2O$/THF-pyridine + 16% MeIm/THF | 0.5 mL | 30 s |
| 4 | oxidation/sulfurization | 0.5M CSO/MeCN or 0.1M POS/MeCN | 0.5 mL | 90 s |

Preparation of Pre-Activated Monomer in Step 2 of TableZ—2:

Nucleoside-3'-H-phosphonate monoester is dried by repeated coevaporations with dry toluene and then dissolved in dry MeCN. $Ph_3PCl_2$ is added to the solution, and the mixture is stirred for 5 min. To the mixture, a solution of chiral reagent, which is repeated coevaportions with dry toluene and dissolved in dry MeCN, is added dropwise via syringe, and the mixture is stirred for 5 min under argon.

After the synthesis, the resin was treated with a 25% $NH_3$ aqueous solution (1 mL) for 12 h at 55° C. The mixture was cooled to room temperature and the resin was removed by membrane filtration. The filtrate was concentrated to dryness under reduced pressure. The residue was dissolved in $H_2O$ (3 mL) and analyzed by RP-UPLC-MS with a linear gradient of acetonitrile (0-50%/30 min) in 0.1 M triethylammonium acetate buffer (pH 7.0) at 50° C. at a rate of 0.3 mL/min.

Example Z-1

(S)-1-Tritylpyrrolidin-2-carbaldehyde (1a)

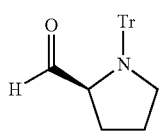

1a

Compound 1a was synthesized from L-proline according to the procedure described in the literature (Guga, P. *Curr. Top. Med. Chem.* 2007, 7, 695-713.).

(R)-1-Tritylpyrrolidin-2-carbaldehyde (1b)

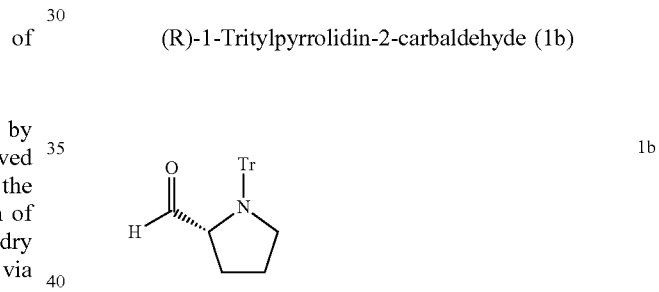

1b

Compound 1b was synthesized from D-proline in a similar manner to compound 1a.

(S)-2-(Methyldiphenyl silyl)-1-((S)-1-tritylpyrrolidin-2-yl)ethanol (2a)

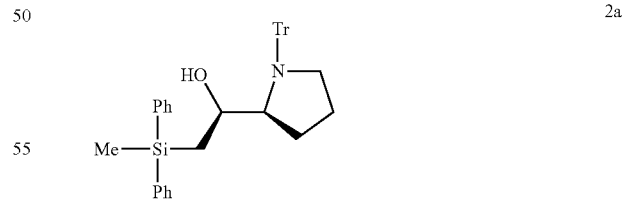

2a

To a solution of methyldiphenylsilylmethyl magnesium chloride in THF prepared from chloromethyldiphenylmethylsilane (4.02 g, 16.3 mmol) and magnesium (402 mg, 16.3 mmol) in THF (14 mL) was added 1a (2.79 g, 8.14 mmol) in THF (30 mL) solution with ice cooling. After stirring for 1.5 h with ice cooling, the mixture warmed to room temperature and continued stirring for 30 min. Saturated aqueous $NH_4Cl$ (100 mL) was added to the reaction mixture at 0° C., and extraction was performed with diethylether (100 mL) for three times. The combined extract was dried over Na₂SO₄, filtered and concentrated under reduced pressure. The residue was chromatographed on silica gel afforded 2a as a colorless foam (3.91 g, 87%). ¹H NMR (300 MHz, CDCl₃) δ 7.48-7.08 (25H, m), 4.33-4.23 (1H, m), 3.16-2.89 (3H, m), 2.84 (1H, brs), 1.70-1.54 (1H, m), 1.35 (1H, dd, J=14.7, 6.3 Hz), 1.10 (1H, dd, J=14.7, 8.1 Hz), 1.18-1.05 (1H, m), 1.04-0.90 (1H, m), 0.34 (3H, s), −0.17--0.36 (1H, m).

(S)-2-(Methyldiphenylsilyl)-1-((S)-1-pyrrolidin-2-yl)ethanol (3a)

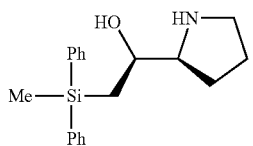

3a 2a (3.91 g, 7.06 mmol) was dissolved in 3% DCA in DCM (70 mL), and stirred for 10 min at room temperature. To the mixture, 1M NaOH (200 mL) was added, and extraction was performed with DCM (100 mL) for three times. The combined extract was dried over Na₂SO₄, filtered and concentrated under reduced pressure. The residue was chromatographed on silica gel afforded 3a as a light yellow oil (1.99 g, 90%). ¹H NMR (300 MHz, CDCl₃) δ 7.57-7.52 (5H, m), 7.38-7.33 (5H, m), 3.77 (1H, ddd, J=8.9, 5.4, 3.5 Hz), 3.01 (1H, dt, J=7.4, 3.6 Hz), 2.97-2.79 (2H, m), 2.27 (2H, brs), 1.76-1.53 (4H, m), 1.38 (1H, dd, J=15.0, 9.0 Hz), 1.24 (1H, dd, J=15.0, 5.4 Hz), 0.65 (3H, s); ¹³C NMR (100.4 MHz, CDCl₃) δ 137.4, 137.1, 134.6, 134.5, 129.1, 127.8, 69.5, 64.1, 47.0, 25.8, 24.0, 19.6, −3.4. MALDI TOF-MS m/z Calcd for C₁₉H₂₆NOSi [M+H]⁺ 312.18, found 312.06.

Example Z-2

(R)-2-(Methyldiphenylsilyl)-1-((R)-1-tritylpyrrolidin-2-yl)ethanol (2b)

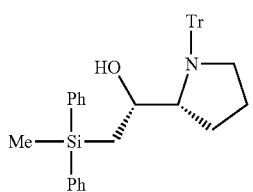

2b

Compound 2b was obtained by using 1b instead of 1a in a similar manner to compound 2a. ¹H NMR (300 MHz, CDCl₃) δ 7.48-7.12 (25H, m), 4.33-4.24 (1H, m), 3.16-2.89 (3H, m), 2.86 (1H, brs), 1.69-1.52 (1H, m), 1.35 (1H, dd, J=14.4, 6.0 Hz), 1.10 (1H, dd, J=14.4, 8.4 Hz), 1.18-1.05 (1H, m), 1.03-0.89 (1H, m), 0.33 (3H, s), −0.19--0.39 (1H, m); ¹³C NMR (75.5 MHz, CDCl₃) δ 144.5, 137.5, 136.8, 134.6, 134.3, 129.8, 129.0, 127.8, 127.7, 127.4, 126.1, 77.9, 71.7, 65.1, 53.5, 25.0, 24.8, 19.6, −4.0. MALDI TOF-MS m/z Calcd for C₃₈H₄₀NOSi [M+H]+ 554.29, found 554.09.

(R)-2-(Methyldiphenylsilyl)-1-((R)-1-pyrrolidin-2-yl)ethanol (3b)

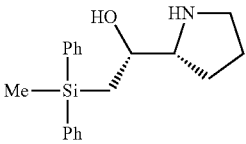

3b

Compound 3b was obtained by using 2b instead of 2a in a similar manner to compound 3a.
¹H NMR (300 MHz, CDCl₃) δ 7.58-7.52 (5H, m), 7.38-7.33 (5H, m), 3.78 (1H, ddd, J=9.0, 5.1, 3.6 Hz), 3.00 (1H, dt, J=7.4, 3.3 Hz), 2.97-2.78 (2H, m), 2.19 (2H, brs), 1.76-1.53 (4H, m), 1.38 (1H, dd, J=14.6, 9.0 Hz), 1.24 (1H, dd, J=14.6, 5.1 Hz), 0.66 (3H, s); ¹³C NMR (75.5 MHz, CDCl₃) δ 137.5, 137.1, 134.5, 134.4, 129.0, 127.7, 69.2, 64.2, 46.9, 25.8, 24.0, 19.7, −3.4. MALDI TOF-MS m/z Calcd for C₁₉H₂₆NOSi [M+H]⁺ 312.18, found 312.09.

Example Z-3

(S)-2-(Trimethyl silyl)-1-((S)-1-tritylpyrrolidin-2-yl)ethanol (4a)

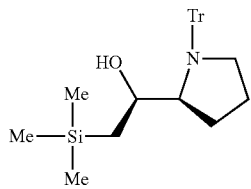

4a

Compound 4a was obtained by using "chloromethyltrimethylsilane" instead of "chloromethyldiphenylmethylsilane" in a similar manner to compound 2a. ¹H NMR (300 MHz, CDCl₃) δ 7.58-7.51 (5H, m), 7.31-7.14 (10H, m), 4.13 (1H, dt, J=7.5, 3.0 Hz), 3.39-3.31 (1H, m), 3.20-2.99 (2H, m), 2.84 (1H, s), 1.74-1.57 (1H, m), 1.29-1.10 (2H, m), 0.74 (1H, dd, J=14.4, 7.2 Hz), 0.46 (1H, dd, J=14.4, 7.2 Hz), −0.15 (9H, s). MALDI TOF-MS m/z Calcd for C₂₈H₃₆NOSi [M+H]⁺ 430.26, found 430.09.

(S)-2-(Trimethyl silyl)-1-((S)-1-pyrrolidin-2-yl)ethanol (5a)

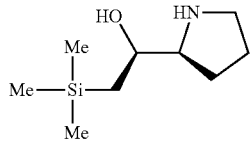

5a

Compound 5a was obtained by using 4a instead of 2a in a similar manner to compound 3a. ¹H NMR (300 MHz, CDCl₃) δ 3.76 (1H, ddd, J=8.8, 5.7, 3.3 Hz), 3.08 (1H, dt, J=7.8, 3.3 Hz), 3.02-2.87 (2H, m), 2.48 (2H, brs), 1.81-1.58 (4H, m), 0.83 (1H, dd, J=14.7, 8.7 Hz), 0.68 (1H, dd, J=14.7, 6.0 Hz), 0.05 (9H, s); $^{13}$C NMR (75.5 MHz, CDCl$_3$) δ 69.6, 64.3, 46.9, 25.8, 23.9, 22.0, −0.8. MALDI TOF-MS m/z Calcd for C$_9$H$_{22}$NOSi [M+H]$^+$ 188.15, found 188.00.

Example Z-5

(R)-2,2-Diphenyl-1-((S)-1-tritylpyrrolidin-2-yl)ethanol (6a)

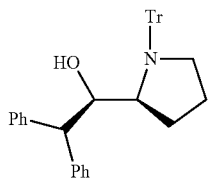

6a

To a solution of diphenylmethane (6.7 mL, 40 mmol) in anhydrous THF (36 mL), n-BuLi (1.67M solution of Hexane, 24 mL, 40 mmol) was added dropwise at room temperature and stirred for 1 h. To the mixture, 1a (3.41 g, 10 mmol), which was dried by repeated coevaporations with toluene, in anhydrous THF (40 mL) was slowly added at 0° C., and continued stirring for 45 min. A saturated NH$_4$Cl aqueous solution (100 mL) and Et$_2$O (100 mL) were then added, and the organic layer was separated and the aqueous layer was extracted with Et$_2$O (2×100 mL). The organic layer were combined, dried over Na$_2$SO$_4$, filtered and concentrated under reduced pressure. The residue was purified by chromatography on silica gel to afford 6a (1.41 g, 28%) as white foam.

(R)-2,2-Diphenyl-1-((S)-pyrrolidin-2-yl)ethanol (7a)

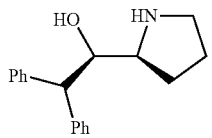

7a 6a (650 mg, 1.27 mmol) was dissolved in 3% DCA in DCM (13 mL), and stirred for 10 min at room temperature. To the mixture, 1M NaOH (40 mL) was added, and extraction was performed with DCM (30 mL) for three times. The combined extract was dried over Na$_2$SO$_4$, filtered and concentrated under reduced pressure. The residue was chromatographed on silica gel afforded 7a as a light yellow oil (316 mg, 93%). $^1$H NMR (300 MHz, CDCl$_3$) δ 7.44-7.38 (2H, m), 7.33-7.14 (8H, m), 4.46 (1H, dd, J=9.9, 3.3 Hz), 3.91 (1H, d, J=9.9 Hz), 3.02-2.88 (2H, m), 2.81-2.69 (1H, m), 2.52 (2H, brs), 1.88-1.56 (4H, m); $^{13}$C NMR (75.5 MHz, CDCl$_3$) δ 142.3, 142.0, 128.6, 128.5, 128.4, 128.2, 126.5, 126.4, 73.5, 60.1, 55.8, 46.6, 25.8, 23.4. MALDI TOF-MS m/z Calcd for C$_{18}$H$_{22}$NO [M+H]$^+$ 268.17, found 268.06.

Example Z-6

(S)-2,2-Diphenyl-1-((R)-1-tritylpyrrolidin-2-yl)ethanol (6b)

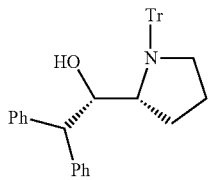

6b

Compound 6b was obtained by using 1b instead of 1a in a similar manner to compound 6a. $^1$H NMR (300 MHz, CDCl$_3$) δ 7.44-7.37 (6H, m), 7.30-7.01 (17H, m), 6.66-6.61 (2H, m), 4.80 (1H, d, J=10.8 Hz), 3.63 (1H, d, J=10.8 Hz), 3.36-3.28 (1H, m), 3.22-3.09 (1H, m), 3.01-2.89 (1H, m), 2.66 (1H, s), 1.90-1.75 (1H, m), 1.29-1.04 (2H, m), 0.00-0.19 (1H, m); $^{13}$C NMR (75.5 MHz, CDCl$_3$) δ 144.2, 142.9, 141.6, 130.0, 128.5, 128.4, 127.9, 127.8, 127.4, 126.4, 126.2, 77.9, 75.9, 61.9, 55.4, 53.4, 24.7, 24.5. MALDI TOF-MS m/z Calcd for C$_{37}$H$_{36}$NO [M+H]$^+$ 510.28, found 510.11.

(S)-2,2-Diphenyl-1-((R)-pyrrolidin-2-yl)ethanol (7b)

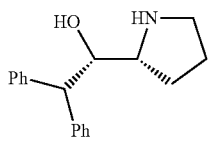

7b

Compound 7b was obtained by using 6b instead of 6a in a similar manner to compound 7a. $^1$H NMR (300 MHz, CDCl$_3$) δ 7.45-7.14 (10H, m), 4.45 (1H, dd, J=9.9, 3.3 Hz), 3.91 (1H, d, J=9.9 Hz), 3.00-2.89 (2H, m), 2.82-2.71 (1H, m), 2.40 (2H, brs), 1.87-1.55 (4H, m); $^{13}$C NMR (75.5 MHz, CDCl$_3$) δ 142.3, 142.0, 128.5, 128.3, 128.1, 126.3, 126.2, 73.4, 60.1, 55.9, 46.5, 25.8, 23.5. MALDI TOF-MS m/z Calcd for C$_{18}$H$_{22}$NO [M+H]$^+$ 268.17, found 268.03.

Example Z-7

(R)-2-(4-Nitrophenyl)-1-((S)-1-tritylpyrrolidin-2-yl)ethanol (8a)

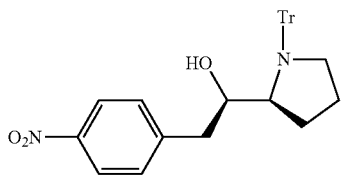

8a

Compound 8a was obtained by using "4-nitrobenzylchloride" instead of "diphenylmethane" in a similar manner to compound 6a. $^1$H NMR (300 MHz, CDCl$_3$) δ 8.09-8.03 (2H, m), 7.49-7.43 (6H, m), 7.28-7.09 (11H, m), 4.23 (1H, ddd, J=8.3, 5.6, 3.0 Hz), 3.43-3.33 (1H, m), 3.23-3.11 (1H, m), 3.07-2.96 (1H, m), 2.83 (1H, brs), 2.74 (1H, dd, J=13.8, 8.4 Hz), 2.49 (1H, dd, J=13.8, 5.1 Hz), 1.83-1.67 (1H, m), 1.41-1.17 (2H, m), 0.27-0.08 (1H, m); $^{13}$C NMR (75.5 MHz, CDCl$_3$) δ 147.3, 146.3, 144.3, 129.8, 129.6, 127.5, 126.3, 123.4, 77.9, 74.8, 63.5, 53.2, 39.5, 25.0, 24.9. MALDI TOF-MS m/z Calcd for $C_{31}H_{31}N_2O_3$ [M+H]$^+$ 479.23, found 479.08.

(R)-2-(4-Nitrophenyl)-1-((S)-pyrrolidin-2-yl)ethanol (9a)

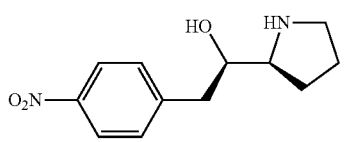

9a

Compound 9a was obtained by using 8a instead of 6a in a similar manner to compound 7a. $^1$H NMR (300 MHz, CDCl$_3$) δ 8.15 (2H, d, J=8.7 Hz), 7.42 (2H, d, J=8.7 Hz), 3.86-3.79 (1H, m), 3.16-3.07 (1H, m), 2.99-2.68 (6H, m), 1.84-1.68 (4H, m); $^{13}$C NMR (75.5 MHz, CDCl$_3$) δ 147.4, 146.2, 129.9, 123.2, 72.4, 62.0, 46.6, 40.4, 25.7, 24.4. MALDI TOF-MS m/z Calcd for $C_{12}H_{17}N_2O_3$ [M+H]$^+$ 237.12, found 237.01.

Example Z-8

(S)-2-(4-Nitrophenyl)-1-((R)-1-tritylpyrrolidin-2-yl)ethanol (8b)

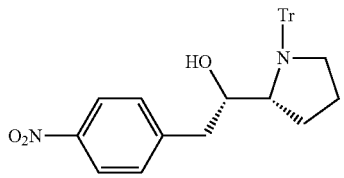

8b

Compound 8b was obtained by using 1b instead of 1a in a similar manner to compound 8a. $^1$H NMR (300 MHz, CDCl$_3$) δ 8.09-8.04 (2H, m), 7.49-7.43 (6H, m), 7.28-7.09 (11H, m), 4.22 (1H, ddd, J=8.4, 5.6, 3.0 Hz), 3.43-3.33 (1H, m), 3.24-3.10 (1H, m), 3.08-2.94 (1H, m), 2.81 (1H, brs), 2.75 (1H, dd, J=14.0, 8.1 Hz), 2.49 (1H, dd, J=14.0, 5.1 Hz), 1.81-1.67 (1H, m), 1.40-1.16 (2H, m), 0.26-0.09 (1H, m); $^{13}$C NMR (75.5 MHz, CDCl$_3$) δ 147.3, 144.3, 129.8, 129.6, 129.4, 126.3, 123.5, 77.9, 74.8, 63.5, 53.2, 39.5, 25.0, 24.9. MALDI TOF-MS m/z Calcd for $C_{31}H_{31}N_2O_3$ [M+H]$^+$ 479.23, found 479.08.

(S)-2-(4-Nitrophenyl)-1-((R)-pyrrolidin-2-yl)ethanol (9b)

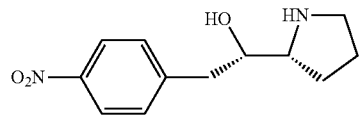

9b

Compound 9b was obtained by using 8b instead of 8a in a similar manner to compound 9a. $^1$H NMR (300 MHz, CDCl$_3$) δ 8.19-8.13 (2H, m), 7.45-7.39 (2H, m), 3.83 (1H, ddd, J=7.7, 5.4, 3.9 Hz), 3.14 (1H, dt, J=7.7, 3.9 Hz), 3.01-2.87 (2H, m), 2.83 (1H, d, J=3.3 Hz), 2.81 (1H, s), 2.62 (2H, brs), 1.79-1.72 (4H, m); $^{13}$C NMR (75.5 MHz, CDCl$_3$) δ 147.3, 146.5, 130.0, 123.5, 72.7, 61.7, 46.7, 40.1, 25.8, 24.2. MALDI TOF-MS m/z Calcd for $C_{12}H_{17}N_2O_3$[M+H]+ 237.12, found 237.02.

Example Z-9

(R)-(9H-Fluoren-9-yl)((S)-1-tritylpyrrolidin-2-yl)methanol (10a)

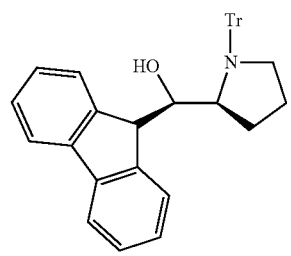

10a

Compound 10a was obtained by using "fluorene" instead of "diphenylmethane" in a similar manner to compound 6a. $^1$H NMR (300 MHz, CDCl$_3$) δ 7.70 (1H, d, J=7.5 Hz), 7.66 (1H, d, J=7.8 Hz), 7.55 (2H, d, J=7.5 Hz), 7.44-7.09 (18H, m), 6.87-6.62 (1H, m), 4.55-4.48 (1H, m), 4.06 (1H, d, J=7.5 Hz), 3.43-3.34 (1H, m), 3.18-3.06 (1H, m), 2.98-2.88 (1H, m), 2.85 (1H, brs), 1.42-1.24 (1H, m), 1.18-1.04 (1H, m), 0.53-0.39 (1H, m), −0.02−−0.20 (1H, m); MALDI TOF-MS m/z Calcd for $C_{37}H_{34}NO$ [M+H]$^+$ 508.26, found 508.12.

(R)-(9H-Fluororen-9-yl)((S)-pyrrolidin-2-yl)methanol (11a)

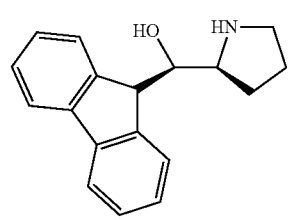

11a

Compound 11a was obtained by using 10a instead of 6a in a similar manner to compound 7a. $^1$H NMR (300 MHz, CDCl$_3$) δ 7.76 (2H, d, J=7.5 Hz), 7.68 (2H, t, J=8.0 Hz), 7.43-7.35 (2H, m), 7.34-7.25 (2H, m), 4.28 (1H, d, J=6.3 Hz), 4.03 (1H, dd, J=6.5, 4.2 Hz), 3.19-3.11 (1H, m), 2.97-2.88 (1H, m), 2.86-2.76 (1H, m), 2.02 (2H, brs), 1.77-1.53 (3H, m), 1.38-1.23 (1H, m); MALDI TOF-MS m/z Calcd for C$_{18}$H$_{20}$NO [M+H]$^+$ 266.15, found 266.04.

(S)-2-Tosyl-1-((S)-1-tritylpyrrolidin-2-yl)ethanol (12a')

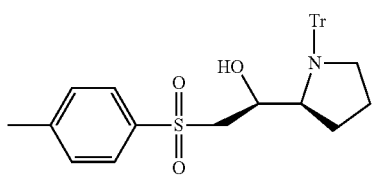

Compound 12a' was obtained by using "chloromethyl p-tolyl sulfone" instead of "chloromethyldiphenylmethylsilane" in a similar manner to compound 2a.

$^1$H NMR (600 MHz, CDCl$_3$) δ 7.66 (2H, d, J=8.4 Hz), 7.48-7.44 (6H, m), 7.35 (2H, d, J=7.2 Hz), 7.21-7.13 (9H, m), 4.39-4.36 (1H, m), 3.33 (1H, s), 3.24-3.20 (1H, m), 3.19-3.10 (2H, m), 2.98-2.92 (2H, m), 2.49 (3H, s), 1.55-1.49 (1H, m), 1.33-1.26 (1H, m), 1.12-1.04 (1H, m), 0.22-0.14 (1H, m); $^{13}$C NMR (150.9 MHz, CDCl$_3$) δ 144.6, 144.5, 136.3, 129.9, 129.5, 128.1, 127.5, 126.2, 78.0, 69.1, 63.9, 60.2, 52.6, 25.5, 24.7, 21.7.

(S)-2-Tosyl-1-((S)-1-tritylpyrrolidin-2-yl)ethanol (13a')

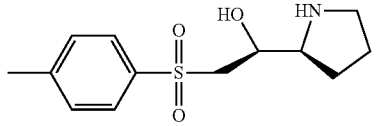

Compound 13a' was obtained by using 12a' instead of 2a in a similar manner to compound 3a.

$^1$H NMR (600 MHz, CDCl$_3$) δ 7.82 (2H, d, J=8.4 Hz), 7.37 (2H, d, J=8.4 Hz), 4.01 (1H, ddd, J=12.0, 5.1, 3.0 Hz), 3.32 (1H, dd, J=14.4, 3.0 Hz), 3.25 (1H, dd, J=14.4, 9.0 Hz), 3.16 (1H, dt, J=7.8, 5.1 Hz), 2.90-2.82 (2H, m), 2.46 (3H, s), 2.04 (2H, brs), 1.78-1.63 (3H, m), 1.62-1.55 (1H, m); $^{13}$C NMR (150.9 MHz, CDCl$_3$) δ 144.5, 136.7, 129.7, 127.7, 67.4, 61.8, 60.1, 46.7, 25.7, 21.4. MALDI TOF-MS m/z Calcd for C$_{13}$H$_{20}$NO$_3$S [M+H]$^+$ 270.12, found 270.04.

(R)-2-Tosyl-1-((R)-1-tritylpyrrolidin-2-yl)ethanol (12b')

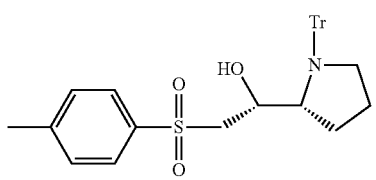

Compound 12b' was obtained by using 1b instead of 1a in a similar manner to compound 12a'.

$^1$H NMR (600 MHz, CDCl$_3$) δ 7.66 (2H, d, J=8.4 Hz), 7.47-7.44 (6H, m), 7.35 (2H, d, J=7.8 Hz), 7.21-7.13 (9H, m), 4.37 (1H, dt, J=8.6, 2.4 Hz), 3.33 (1H, s), 3.23-3.20 (1H, m), 3.19-3.12 (2H, m), 2.98-2.92 (2H, m), 2.49 (3H, s), 1.56-1.49 (1H, m), 1.32-1.26 (1H, m), 1.11-1.03 (1H, m), 0.23-0.15 (1H, m); $^{13}$C NMR (150.9 MHz, CDCl$_3$) δ 144.6, 144.5, 136.3, 129.9, 129.6, 128.1, 127.6, 126.2, 78.0, 69.1, 63.9, 60.2, 52.6, 25.5, 24.7, 21.7.

(R)-2-Tosyl-1-((R)-1-tritylpyrrolidin-2-yl)ethanol (13b')

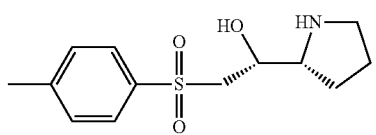

Compound 13b' was obtained by using 12b' instead of 12a' in a similar manner to compound 13a'.

$^1$H NMR (600 MHz, CDCl$_3$) δ 7.82 (2H, d, J=8.4 Hz), 7.37 (2H, d, J=8.4 Hz), 4.01 (1H, ddd, J=9.0, 5.1, 3.0 Hz), 3.32 (1H, dd, J=14.4, 3.0 Hz), 3.25 (1H, dd, J=14.4, 9.0 Hz), 3.17 (1H, dt, J=7.2, 5.1 Hz), 2.89-2.83 (2H, m), 2.46 (3H, s), 2.04 (2H, brs), 1.79-1.64 (3H, m), 1.62-1.55 (1H, m); $^{13}$C NMR (150.9 MHz, CDCl$_3$) δ 144.8, 136.6, 129.8, 127.9, 67.7, 61.8, 60.1, 46.8, 25.9, 25.8, 21.6. MALDI TOF-MS m/z Calcd for C$_{13}$H$_{20}$NO$_3$S [M+H]$^+$ 270.12, found 270.05.

Example Z-10

Oxazaphospholidine Monomer 12a.

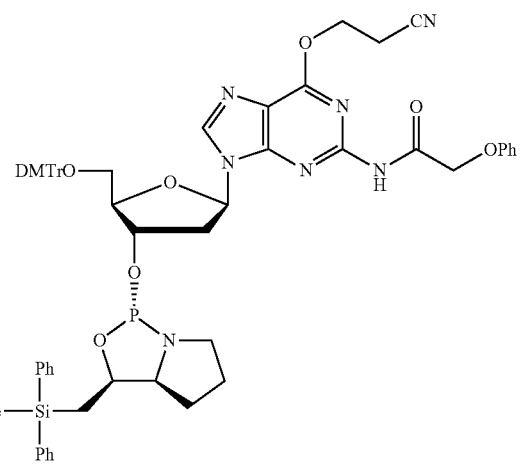

3a (560 mg, 1.80 mmol) were dried by repeated coevaporations with dry toluene and dissolved in dry diethylether (0.90 mL) under argon. N-Methylmorpholine (400 micro L, 3.60 mmol) was added to the solution, and the resultant solution was added dropwise to a solution of PCl$_3$ (160 micro L, 1.80 mmol) in dry diethylether (0.90 mL) at 0° C. under argon with stirring. The mixture was then allowed to warm to room temperature and stirred for 30 min. The resultant N-methylmorpholine hydrochloride was removed by filtration under nitrogen, and the filtrate was concentrated to dryness under reduced pressure to afford crude 2-chloro-1,3,2-oxazaphospholidine derivative. The crude materials were dissolved in freshly distilled THF (3.6 mL) to make 0.5 M solutions, which were used to synthesize the nucleoside 3'-O-oxazaphospholidines without further purification.

5'-O-(DMTr)-2-N-(phenoxyacetyl)-6-O-(cyanoethyl) guanosine (636 mg, 0.84 mmol) was dried by repeated coevaporations with dry toluene, and dissolved in freshly distilled THF (2.5 mL) under argon. Et$_3$N (0.58 mL, 4.2 mmol) was added, and the mixture was cooled to −78° C. A 0.5 M solution of the corresponding crude 2-chloro-1,3,2-oxazaphospholidine derivative in freshly distilled THF (3.6 mL, 1.80 mmol) was added dropwise via a syringe, and the mixture was stirred for 15 min at room temperature. A saturated NaHCO$_3$ aqueous solution (70 mL) and CHCl$_3$ (70 mL) were then added, and the organic layer was separated and washed with saturated NaHCO$_3$ aqueous solutions (2×70 mL). The combined aqueous layers were back-extracted with CHCl$_3$ (70 mL). The organic layers were combined, dried over Na$_2$SO$_4$, filtered and concentrated under reduced pressure. The residue was purified by chromatography on silica gel to afford 12a (829 mg, 90%) as a white foam. $^1$H NMR (300 MHz, CDCl$_3$) δ 8.77 (1H, brs), 7.99 (1H, s), 7.54-6.98 (24H, m), 6.81-6.73 (4H, m), 6.35 (1H, dd, J=8.0, 6.3 Hz), 4.89-4.73 (4H, m), 4.68 (2H, brs), 4.05-3.98 (1H, m), 3.75 (6H, s), 3.62-3.46 (1H, m), 3.41-3.20 (3H, m), 3.18-3.04 (1H, m), 3.08 (2H, t, J=6.6 Hz), 2.58-2.36 (2H, m), 1.94-1.59 (2H, m), 1.56 (1H, dd, J=15.0, 8.7 Hz), 1.43 (1H, dd, J=15.0, 5.7 Hz), 1.33-1.16 (2H, m), 0.62 (3H, s); $^{31}$P NMR (121.5 MHz, CDCl$_3$) δ 153.5 (1P, s).

Example Z-11

Oxazaphospholidine Monomer 12b.

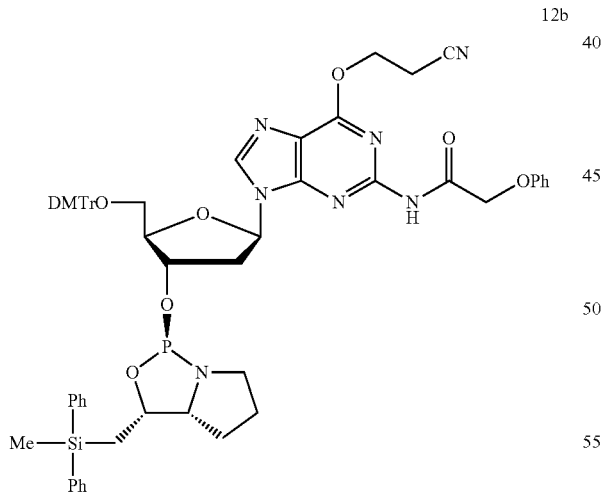

Compound 12b was obtained by using 3b instead of 3a in a similar manner to compound 12a. $^1$H NMR (300 MHz, CDCl$_3$) δ 8.80 (1H, brs), 7.96 (1H, s), 7.54-6.96 (24H, m), 6.79-6.71 (4H, m), 6.19 (1H, t, J=6.6 Hz), 4.90-4.73 (4H, m), 4.66 (2H, brs), 4.16-4.08 (1H, m), 3.76 (6H, s), 3.60-3.36 (2H, m), 3.29 (1H, d, J=3.9 Hz), 3.27-3.12 (2H, m), 3.09 (2H, t, J=6.6 Hz), 2.59-2.46 (1H, m), 2.07-1.97 (1H, m), 1.94-1.41 (5H, m), 1.36-1.18 (1H, m), 0.65 (3H, s); $^{31}$P NMR (121.5 MHz, CDCl$_3$) δ 157.1 (1P, s).

Example Z-12

Oxazaphospholidine Monomer 13a.

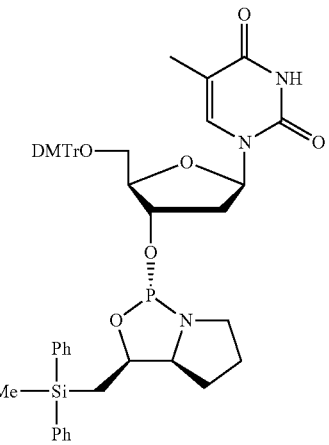

Compound 13a was obtained by using "5'-O-(DMTr) thymidine" instead of "5'-O-(DMTr)-2-N-(phenoxyacetyl)-6-O-(cyanoethyl)guanosine" in a similar manner to compound 12a. $^1$H NMR (300 MHz, CDCl$_3$) δ 7.58-7.23 (21H, m), 6.86-6.79 (4H, m), 6.35 (1H, dd, J=8.1, 5.7 Hz), 4.79-4.67 (2H, m), 3.83-3.78 (1H, m), 3.78 (6H, s), 3.59-3.43 (1H, m), 3.34 (1H, dd, J=10.5, 2.4 Hz), 3.35-3.24 (1H, m), 3.20 (1H, dd, J=10.5, 2.4 Hz), 3.16-3.02 (1H, m), 2.36-2.26 (1H, m), 2.15-2.02 (1H, m), 1.92-1.77 (1H, m), 1.74-1.59 (1H, m), 1.52 (1H, dd, J=14.7, 9.0 Hz), 1.40 (3H, s), 1.45-1.15 (3H, m), 0.60 (3H, s); $^{31}$P NMR (121.5 MHz, CDCl$_3$) δ 153.7 (1P, s).

Example Z-13

Oxazaphospholidine Monomer 13b.

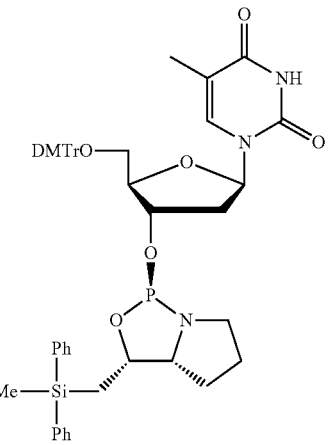

Compound 13b was obtained by using 3b instead of 3a in a similar manner to compound 13a. $^1$H NMR (300 MHz, CDCl$_3$) δ 8.46 (1H, brs), 7.59-7.20 (20H, m), 6.86-6.79 (4H, m), 6.26 (1H, t, J=6.8 Hz), 4.78-4.65 (2H, m), 4.01-3.95 (1H, m), 3.78 (6H, s), 3.55-3.40 (1H, m), 3.42 (1H, dd, J=10.5, 2.7 Hz), 3.40-3.28 (1H, m), 3.22 (1H, dd, J=10.5, 3.0

Hz), 3.19-3.06 (1H, m), 2.16-1.95 (2H, m), 1.90-1.54 (3H, m), 1.49-1.35 (1H, m), 1.43 (3H, s), 1.34-1.17 (2H, m), 0.67 (3H, s); $^{31}$P NMR (121.5 MHz, CDCl$_3$) δ 156.2 (1P, s). Oligos were synthesized using the above compound 13b by the general method disclosed above.

Example Z-14

Oxazapholidine Monomer 14a.

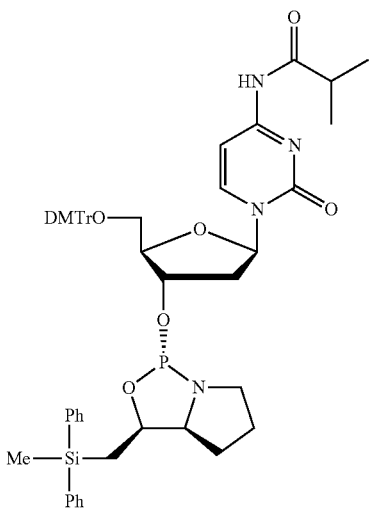

14a

Compound 14a was obtained by using "5'-O-(DMTr)-4-N-(isobutyryl)cytidine" instead of "5'-O-(DMTr)-2-N-(phenoxyacetyl)-6-O-(cyanoethyl)guanosine" in a similar manner to compound 12a. $^1$H NMR (300 MHz, CDCl$_3$) δ 8.33 (1H, brs), 8.17 (1H, d, J=7.5 Hz), 7.52-7.22 (19H, m), 7.07 (1H, d, 0.1=7.5 Hz), 6.88-6.81 (4H, m), 6.20 (1H, t, J=6.2 Hz), 4.81-4.64 (2H, m), 3.93-3.87 (1H, m), 3.79 (6H, s), 3.59-3.43 (1H, m), 3.39-3.29 (3H, m), 3.16-3.02 (1H, m), 2.69-2.52 (2H, m), 2.12-2.00 (1H, m), 1.91-1.50 (3H, m), 1.47-1.32 (2H, m), 1.27-1.16 (7H, m), 0.60 (3H, s); $^{31}$P NMR (121.5 MHz, CDCl$_3$) δ 154.8 (1P, s).

Example Z-16

Oxazapholidine Monomer 14b.

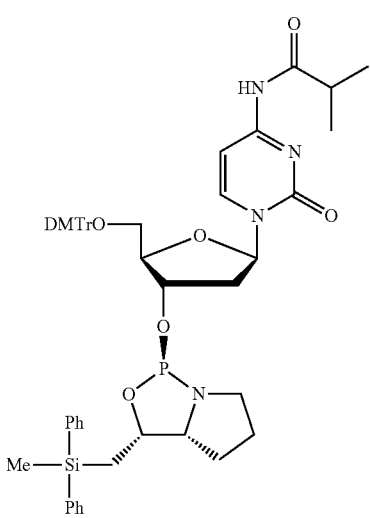

14b

Compound 14b was obtained by using 3b instead of 3a in a similar manner to compound 14a. $^1$H NMR (300 MHz, CDCl$_3$) δ 8.33 (1H, d, J=7.5 Hz), 8.23 (1H, brs), 7.57-7.22 (19H, m), 7.12 (1H, d, J=7.5 Hz), 6.88-6.81 (4H, m), 6.15 (1H, dd, J=6.6, 4.2 Hz), 4.82-4.63 (2H, m), 4.03-3.97 (1H, m), 3.80 (6H, s), 3.55-3.26 (4H, m), 3.19-3.05 (1H, m), 2.59 (1H, quintet, J=6.9 Hz), 2.39-2.27 (1H, m), 2.21-2.10 (1H, m), 1.90-1.56 (3H, m), 1.50-1.32 (2H, m), 1.26-1.17 (7H, m), 0.66 (3H, s); $^{31}$P NMR (121.5 MHz, CDCl$_3$) δ 157.2 (1P, s).

Example Z-17

Oxazapholidine Monomer 15a.

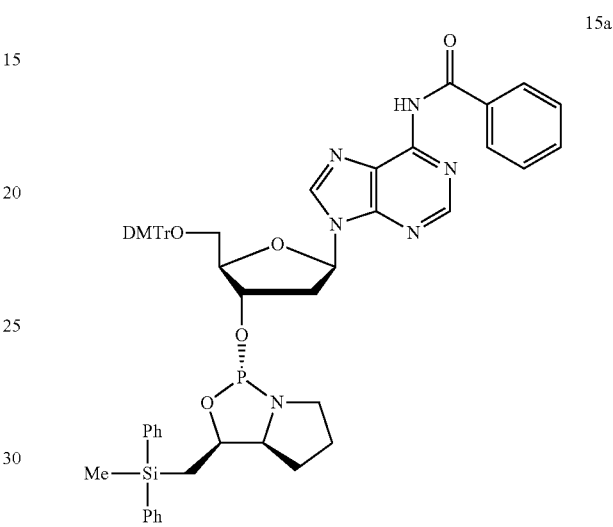

15a

Compound 15a was obtained by using "5'-O-(DMTr)-6-N-(benzoyl)adenosine" instead of "5'-O-(DMTr)-2-N-(phenoxyacetyl)-6-O-(cyanoethyl)guanosine" in a similar manner to compound 12a.

$^1$H NMR (600 MHz, CDCl$_3$) δ 8.71 (1H, s), 8.12 (1H, s), 8.04 (2H, d, J=7.8 Hz), 7.62-7.15 (23H, m), 6.80-6.75 (4H, m), 6.37 (1H, dd, J=7.8, 6.0 Hz), 4.94-4.88 (1H, m), 4.80 (1H, ddd, J=12.0, 6.0, 5.4 Hz), 4.07-4.04 (1H, m), 3.76 (6H, s), 3.58-3.49 (1H, m), 3.41-3.34 (1H, m), 3.33 (1H, dd, J=10.8, 4.8 Hz), 3.25 (1H, dd, J=10.8, 4.8 Hz), 3.13-3.06 (1H, m), 2.66-2.58 (1H, m), 2.40-2.35 (1H, m), 1.91-1.84 (1H, m), 1.73-1.66 (1H, m), 1.56 (1H, dd, J=15.0, 9.0 Hz), 1.44 (1H, dd, J=15.0, 5.4 Hz), 1.47-1.41 (1H, m), 1.30-1.23 (1H, m), 0.63 (3H, s); $^{31}$P NMR (243.0 MHz, CDCl$_3$) δ 151.8 (1P, s).

Example Z-18

Oxazapholidine Monomer 15b.

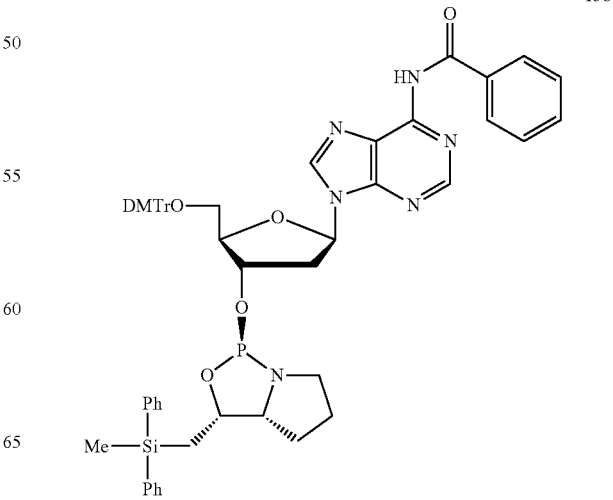

15b

Compound 15b was obtained by using 3b instead of 3a in a similar manner to compound 15a. $^1$H NMR (300 MHz, CDCl$_3$) δ 9.06 (1H, brs), 8.76 (1H, s), 8.12 (1H, s), 8.07-7.99 (2H, m), 7.64-7.14 (22H, m), 6.83-6.75 (4H, m), 6.25 (1H, t, J=6.6 Hz), 4.86-4.75 (2H, m), 4.20-4.15 (1H, m), 3.77 (6H, s), 3.61-3.38 (2H, m), 3.36 (1H, dd, J=10.2, 4.2 Hz), 3.27 (1H, dd, J=10.2, 4.2 Hz), 3.27-3.13 (1H, m), 2.71-2.59 (1H, m), 2.12-2.01 (1H, m), 1.94-1.42 (5H, m), 1.36-1.20 (1H, m), 0.67 (3H, s)); $^{31}$P NMR (121.5 MHz, CDCl$_3$) δ 157.3 (1P, s).

Example Z-19

Oxazaphospholidine Monomer 16a.

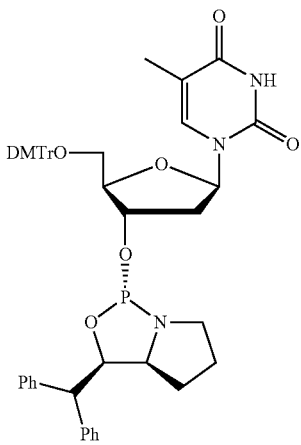

16a

Compound 16a was obtained by using 7a instead of 3a in a similar manner to compound 13a. H NMR (300 MHz, CDCl$_3$) δ 7.57 (1H, d, J=0.9 Hz), 7.37-6.94 (20H, m), 6.87-6.78 (4H, m), 6.48 (1H, dd, J=8.6, 5.7 Hz), 5.42 (1H, dd, J=11.0, 5.1 Hz), 4.81-4.71 (1H, m), 4.02 (1H, d, J=11.0 Hz), 3.83 (1H, d, J=2.1 Hz), 3.79 (6H, s), 3.61-3.41 (2H, m), 3.24-3.09 (1H, m), 3.16 (1H, dd, J=10.8, 2.4 Hz), 3.02 (1H, dd, J=10.8, 2.4 Hz), 2.54-2.44 (1H, m), 2.34-2.22 (1H, m), 1.94-1.79 (1H, m), 1.74-1.56 (1H, m), 1.38 (3H, s), 1.38-1.28 (2H, m); $^{31}$P NMR (121.5 MHz, CDCl$_3$) δ 160.9 (1P, s).

Example Z-20

Oxazaphospholidine Monomer 16b.

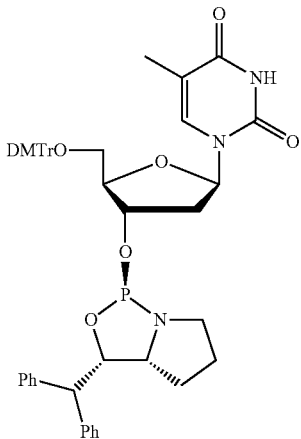

16b

Compound 16b was obtained by using 3b instead of 3a in a similar manner to compound 16a. $^1$H NMR (300 MHz, CDCl$_3$) δ 7.57 (1H, d, J=1.5 Hz), 7.43-7.11 (20H, m), 6.85-6.78 (4H, m), 6.48 (1H, dd, J=7.5, 5.7 Hz), 5.58 (1H, dd, J=11.4, 5.1 Hz), 4.82-4.73 (1H, m), 4.17-4.02 (2H, m), 3.78 (6H, s), 3.56-3.40 (3H, m), 3.32 (1H, dd, J=10.7, 2.4 Hz), 3.22-3.07 (1H, m), 2.26-2.04 (2H, m), 1.95-1.81 (1H, m), 1.74-1.56 (1H, m), 1.40 (3H, d, J=1.5 Hz), 1.44-1.34 (2H, m); $^{31}$P NMR (121.5 MHz, CDCl$_3$) δ 162.2 (1P, s).

Example Z-21

Oxazaphospholidine Monomer 17a.

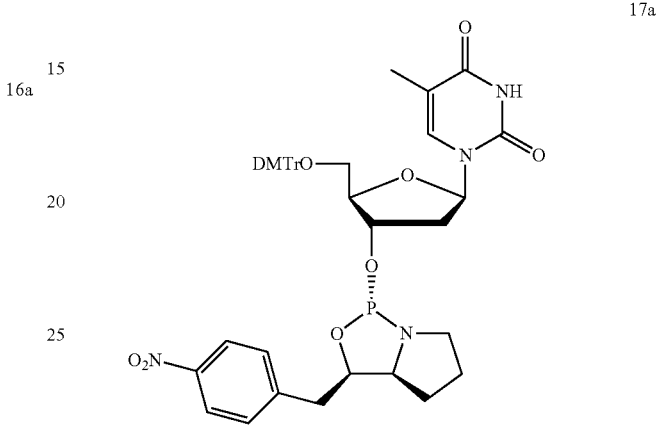

17a

Compound 17a was obtained by using 9a instead of 3a in a similar manner to compound 13a. $^1$H NMR (300 MHz, CDCl$_3$) δ 9.22 (1H, brs), 8.05-7.99 (2H, m), 7.52 (1H, d, J=1.2 Hz), 7.41-7.19 (11H, m), 6.87-6.79 (4H, m), 6.37 (1H, dd, J=8.4, 5.7 Hz), 4.88-4.75 (2H, m), 3.86-3.80 (1H, m), 3.79 (6H, d, J=1.2 Hz), 3.64-3.49 (2H, m), 3.27-3.12 (3H, m), 2.97 (2H, d, J=6.6 Hz), 2.51-2.41 (1H, m), 2.33-2.20 (1H, m), 2.03-1.75 (2H, m), 1.72-1.59 (1H, m), 1.46-1.36 (1H, m), 1.40 (3H, s); $^{31}$P NMR (121.5 MHz, CDCl$_3$) δ 157.5 (1P, s).

Example Z-22

Oxazaphospholidine Monomer 17b.

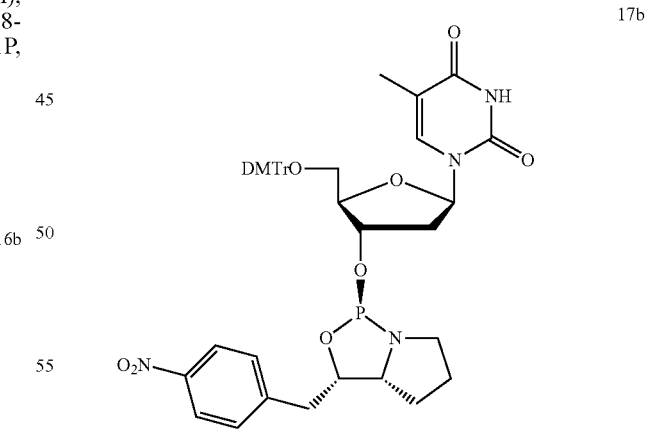

17b

Compound 17b was obtained by using 9b instead of 9a in a similar manner to compound 17a. H NMR (300 MHz, CDCl$_3$) δ 8.67 (1H, brs), 8.18-8.11 (2H, m), 7.57 (1H, d, J=1.2 Hz), 7.47-7.22 (11H, m), 6.86-6.79 (4H, m), 6.29 (1H, t, J=6.6 Hz), 4.87 (1H, dt, J=7.5, 5.7 Hz), 4.80-4.72 (1H, m), 4.11-4.05 (1H, m), 3.79 (6H, s), 3.67-3.47 (2H, m), 3.43 (1H, dd, J=10.8, 2.7 Hz), 3.27 (1H, dd, J=10.8, 2.4 Hz), 3.25-3.13 (1H, m), 3.07-2.99 (2H, m), 2.19-2.12 (2H, m), 2.03-1.62 (3H, m), 1.46-1.30 (1H, m), 1.41 (3H, s); $^{31}$P NMR (121.5 MHz, CDCl$_3$) δ 158.1 (1P, s).

Example Z-23

Oxazaphospholidine Monomer 18a.

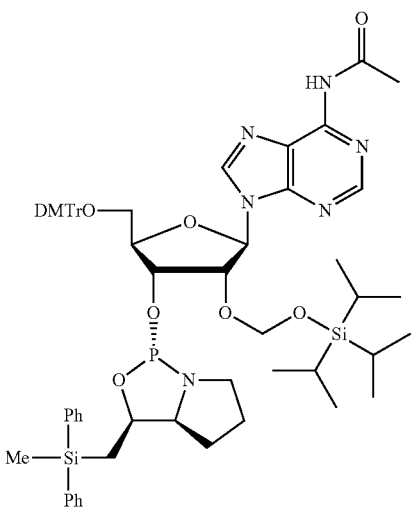

18a

Compound 18a was obtained by using "5'-O-(DMTr)-2'-O-TOM-6-N-(acetyl)adenosine" instead of "5'-O-(DMTr)-2-N-(phenoxyacetyl)-6-O-(cyanoethyl)guanosine" in a similar manner to compound 12a. $^1$H NMR (300 MHz, CDCl$_3$) δ 8.82 (1H, brs), 8.49 (1H, s), 8.10 (1H, s), 7.58-7.17 (19H, m), 6.83-6.73 (4H, m), 6.11 (1H, d, J=6.6 Hz), 5.15 (1H, dd, J=6.6, 5.4 Hz), 4.98-4.77 (4H, m), 4.18-4.11 (1H, m), 3.76 (6H, s), 3.59-3.25 (4H, m), 3.16-3.02 (1H, m), 2.62 (3H, s), 1.91-1.53 (3H, m), 1.49-1.18 (3H, m), 0.96-0.80 (3H, m), 0.90 (18H, s), 0.62 (3H, s); $^{31}$P NMR (121.5 MHz, CDCl$_3$) δ 156.7 (1P, s).

Example Z-24

Oxazaphospholidine Monomer 18b.

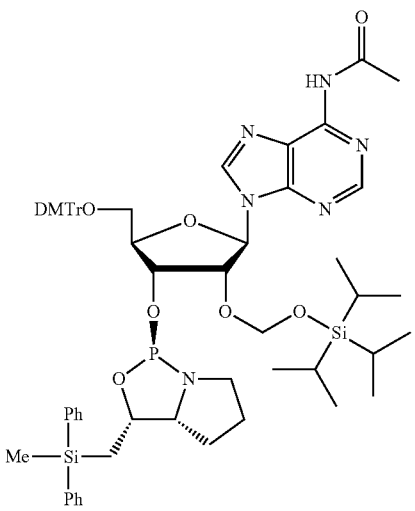

18b

Compound 18b was obtained by using 3b instead of 3a in a similar manner to compound 18a. $^1$H NMR (300 MHz, CDCl$_3$) δ 8.56 (1H, brs), 8.55 (1H, s), 8.13 (1H, s), 7.57-7.17 (19H, m), 6.82-6.73 (4H, m), 6.16 (1H, d, J=5.7 Hz), 5.06 (1H, t, J=5.6 Hz), 4.93 (1H, d, J=5.1 Hz), 4.83 (1H, d, J=5.1 Hz), 4.81-4.69 (2H, m), 4.27-4.19 (1H, m), 3.76 (6H, s), 3.55-3.40 (2H, m), 3.33-3.16 (2H, m), 3.12-2.97 (1H, m), 2.63 (3H, s), 1.88-1.52 (3H, m), 1.45-1.16 (3H, m), 0.91-0.79 (3H, m), 0.86 (18H, s), 0.64 (3H, s); $^{31}$P NMR (121.5 MHz, CDCl$_3$) δ 154.8 (1P, s).

Example Z-25

Oxazaphospholidine Monomer 19a.

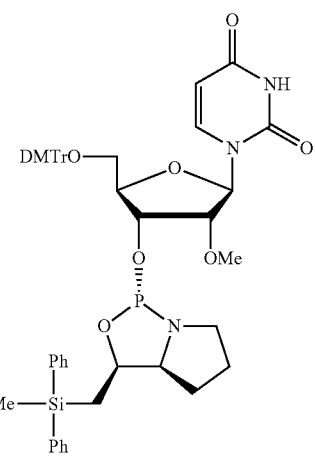

19a

Compound 19a was obtained by using "5'-O-(DMTr)-2'-O-(methyl)uridine" instead of "5'-O-(DMTr)-2-N-(phenoxyacetyl)-6-O-(cyanoethyl)guanosine" in a similar manner to compound 12a. $^1$H NMR (300 MHz, CDCl$_3$) δ 7.91 (1H, d, J=7.8 Hz), 7.58-7.20 (19H, m), 6.88-6.80 (4H, m), 5.96 (1H, d, J=3.3 Hz), 5.19 (1H, d, J=7.8 Hz), 4.88-4.78 (1H, m), 4.66-4.57 (1H, m), 4.03-3.95 (1H, m), 3.90-3.74 (1H, m), 3.78 (6H, s), 3.77-3.71 (1H, m), 3.58-3.29 (2H, m), 3.45 (3H, s), 3.13-2.82 (2H, m), 1.88-1.53 (3H, m), 1.49-1.16 (3H, m), 0.60 (3H, s); $^{31}$P NMR (121.5 MHz, CDCl$_3$) δ 155.3 (1P, s).

Example Z-26

Oxazaphospholidine Monomer 19b.

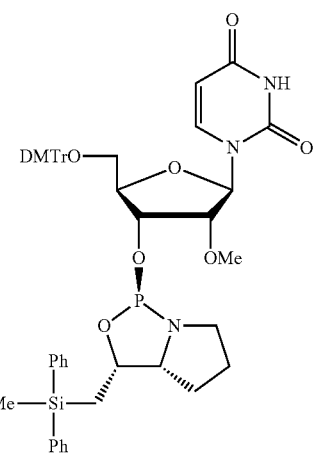

19b

Compound 19b was obtained by using 3b instead of 3a in a similar manner to compound 19a. $^1$H NMR (300 MHz, CDCl$_3$) δ 8.10 (1H, d, J=8.4 Hz), 7.58-7.20 (19H, m), 6.87-6.79 (4H, m), 5.89 (1H, d, J=1.5 Hz), 5.21 (1H, d, J=8.4 Hz), 4.92-4.82 (1H, m), 4.73-4.63 (1H, m), 4.15-4.08 (1H, m), 3.89-3.73 (1H, m), 3.78 (6H, s), 3.66-3.62 (1H, m), 3.57-3.27 (2H, m), 3.30 (3H, s), 3.17-2.82 (2H, m), 1.89-1.55 (3H, m), 1.55-1.40 (1H, m), 1.35-1.15 (2H, m), 0.66 (3H, s); $^{31}$P NMR (121.5 MHz, CDCl$_3$) δ 157.5 (1P, s).

Example Z-27

Oxazaphospholidine Monomer 20a.

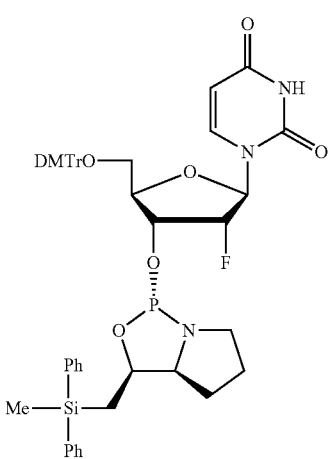

20a

Compound 20a was obtained by using "5'-O-(DMTr)-2'-deoxy-2'-fluorouridine" instead of "5'-O-(DMTr)-2-N-(phenoxyacetyl)-6-O-(cyanoethyl)guanosine" in a similar manner to compound 12a. $^1$H NMR (300 MHz, CDCl$_3$) δ 7.85 (1H, d, J=8.1 Hz), 7.58-7.20 (19H, m), 6.87-6.79 (4H, m), 5.98 (1H, d, J=16.5 Hz), 5.23 (1H, d, J=8.1 Hz), 4.86-4.61 (3H, m), 3.99 (1H, d, J=6.9 Hz), 3.76 (6H, d, J=3.0 Hz), 3.56-3.34 (4H, m), 3.10-2.96 (1H, m), 1.88-1.74 (1H, m), 1.72-1.52 (2H, m), 1.48-1.16 (3H, m), 0.61 (3H, s); $^{31}$P NMR (121.5 MHz, CDCl$_3$) δ 154.3 (1P, d, J=8.9 Hz).

Example Z-28

Oxazaphospholidine Monomer 20b.

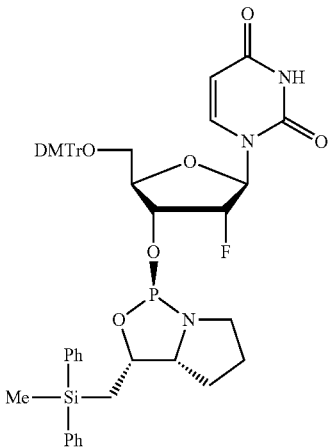

20b

Compound 20b was obtained by using 3b instead of 3a in a similar manner to compound 20a. $^1$H NMR (300 MHz, CDCl$_3$) δ 8.01 (1H, d, J=8.4 Hz), 7.58-7.20 (19H, m), 6.87-6.79 (4H, m), 6.03 (1H, d, J=16.2 Hz), 5.29 (1H, d, J=8.4 Hz), 4.96 (1H, dd, J=13.1, 7.5 Hz), 4.80-4.54 (2H, m), 4.15 (1H, d, 0.1=9.0 Hz), 3.78 (6H, s), 3.61-3.39 (3H, m), 3.37-3.25 (1H, m), 3.23-3.09 (1H, m), 1.91-1.56 (3H, m), 1.51-1.13 (3H, m), 0.66 (3H, s); 31P NMR (121.5 MHz, CDCl$_3$) δ 158.9 (1P, d, J=4.4 Hz).

Example Z-29

Oxazaphospholidine Monomer 21a.

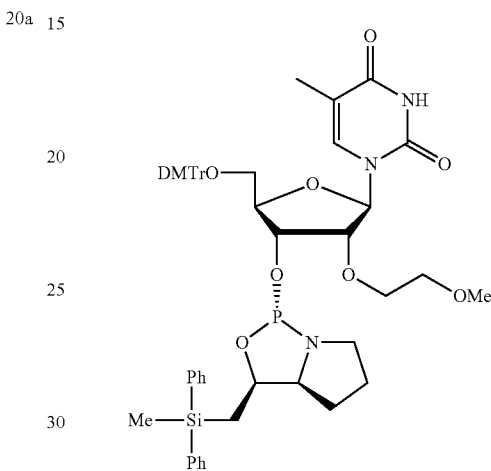

21a

Compound 21a was obtained by using "5'-O-(DMTr)-2'-O-methoxyethyl-5-methyluridine" instead of "5'-O-(DMTr)-2-N-(phenoxyacetyl)-6-O-(cyanoethyl)guanosine" in a similar manner to compound 12a. $^1$H NMR (300 MHz, CDCl$_3$) δ 7.62-7.18 (21H, m), 6.84 (4H, d, J=8.7 Hz), 6.07 (1H, d, J=5.7 Hz), 4.86-4.76 (1H, m), 4.63-4.54 (1H, m), 4.20 (1H, t, J=5.4 Hz), 3.95-3.89 (1H, m), 3.78 (6H, s), 3.78-3.71 (2H, m), 3.60-3.48 (2H, m), 3.44-3.02 (5H, m), 3.31 (3H, s), 1.88-1.15 (6H, m), 1.35 (3H, s), 0.58 (3H, s); $^{31}$P NMR (121.5 MHz, CDCl$_3$) δ 156.3 (1P, s).

Example Z-30

Oxazaphospholidine Monomer 21b.

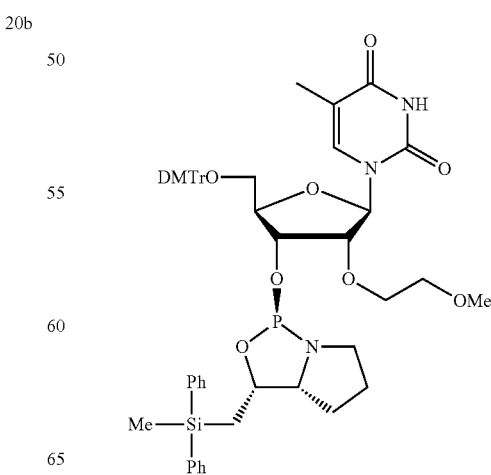

21b

Compound 21b was obtained by using 3b instead of 3a in a similar manner to compound 21a. H NMR (300 MHz, CDCl₃) δ 7.71 (1H, d, J=1.2 Hz), 7.55-7.22 (20H, m), 6.86-6.78 (4H, m), 5.99 (1H, d, J=3.9 Hz), 4.78-4.62 (2H, m), 4.13-4.08 (1H, m), 4.07-4.02 (1H, m), 3.77 (6H, s), 3.77-3.70 (1H, m), 3.65-3.56 (1H, m), 3.52-3.36 (4H, m), 3.33-3.14 (2H, m), 3.29 (3H, s), 3.08-2.94 (1H, m), 1.86-1.72 (1H, m), 1.71-1.55 (2H, m), 1.30 (3H, d, J=1.2 Hz), 1.47-1.16 (3H, m) 0.64 (3H, s); ³¹P NMR (121.5 MHz, CDCl₃) δ 155.6 (1P, s).

Example Z-31

Oxazaphospholidine Monomer 22a.

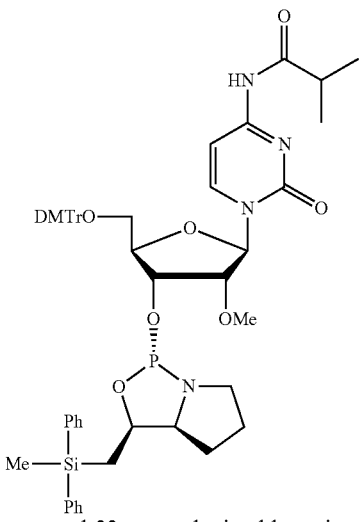

22a

Compound 22a was obtained by using "5'-O-(DMTr)-2'-O-methyl-4-N-(isobutyryl)cytidine" instead of "5'-O-(DMTr)-2-N-(phenoxyacetyl)-6-O-(cyanoethyl)guanosine" in a similar manner to compound 12a. ¹H NMR (300 MHz, CDCl₃) δ 8.49 (1H, d, J=7.2 Hz), 7.58-7.20 (19H, m), 6.96 (1H, d, J=7.2 Hz), 6.90-6.82 (4H, m), 5.98 (1H, s), 4.84 (1H, dd, J=13.1, 7.5 Hz), 4.59 (1H, dt, J=8.3, 4.5 Hz), 4.19-4.13 (1H, m), 3.79 (6H, s), 3.78-3.72 (1H, m), 3.63-3.40 (3H, m), 3.55 (3H, s), 3.36-3.24 (1H, m), 3.09-2.95 (1H, m), 2.59 (1H, septet, J=6.9 Hz), 1.85-1.53 (5H, m), 1.48-1.37 (1H, m), 1.24-1.17 (6H, m), 0.59 (3H, s); ³¹P NMR (121.5 MHz, CDCl₃) δ 155.2 (1P, s).

Example Z-32

Oxazaphospholidine Monomer 22b.

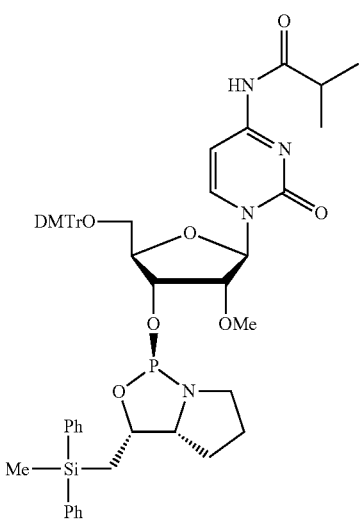

22b

Compound 22b was obtained by using 3b instead of 3a in a similar manner to compound 22a. ¹H NMR (300 MHz, CDCl₃) δ 8.62 (1H, d, J=7.5 Hz), 7.57-7.23 (19H, m), 7.02 (1H, d, J=7.5 Hz), 6.89-6.81 (4H, m), 5.92 (1H, s), 4.90 (1H, dt, J=9.0, 5.7 Hz), 4.61 (1H, dt, J=8.7, 4.8 Hz), 4.25-4.17 (1H, m), 3.81 (6H, s), 3.67 (1H, d, J=4.5 Hz), 3.62-3.25 (4H, m), 3.38 (3H, s), 3.16-3.02 (1H, m), 2.58 (1H, septet, J=6.9 Hz), 1.87-1.40 (6H, m), 1.26-1.14 (6H, m), 0.64 (3H, s); ³¹P NMR (121.5 MHz, CDCl₃) δ 158.2 (1P, s).

Example Z-33

Oxazaphospholidine Monomer 23a.

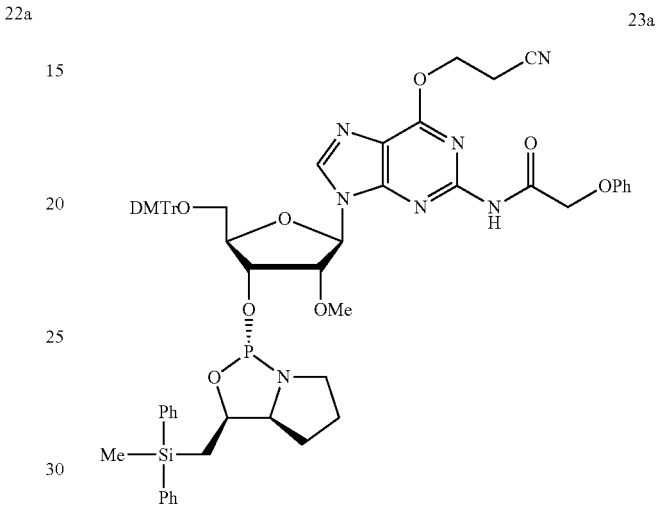

23a

Compound 23a was obtained by using "5'-O-(DMTr)-2'-O-methyl-2-N-(phenoxyacetyl)-6-O-(cyanoethyl)guanosine" instead of "5'-O-(DMTr)-2-N-(phenoxyacetyl)-6-O-(cyanoethyl)guanosine" in a similar manner to compound 12a. ¹H NMR (300 MHz, CDCl₃) δ 8.67 (1H, brs), 8.01 (1H, s), 7.56-7.16 (24H, m), 6.83-6.74 (4H, m), 6.08 (1H, d, J=6.9 Hz), 4.85-4.76 (1H, m), 4.84 (2H, t, J=6.6 Hz), 4.65-4.56 (1H, m), 4.59 (2H, brs), 4.48 (1H, dd, J=6.6, 5.1 Hz), 4.09-4.05 (1H, m), 3.75 (6H, s), 3.60-3.42 (2H, m), 3.40-3.26 (2H, m), 3.35 (3H, s), 3.18-3.05 (1H, m), 3.08 (2H, t, J=6.6 Hz), 1.89-1.49 (3H, m), 1.48-1.16 (3H, m), 0.59 (3H, s); ³¹P NMR (121.5 MHz, CDCl₃) δ 156.9 (1P, s).

Example Z-34

Oxazaphospholidine Monomer 23b.

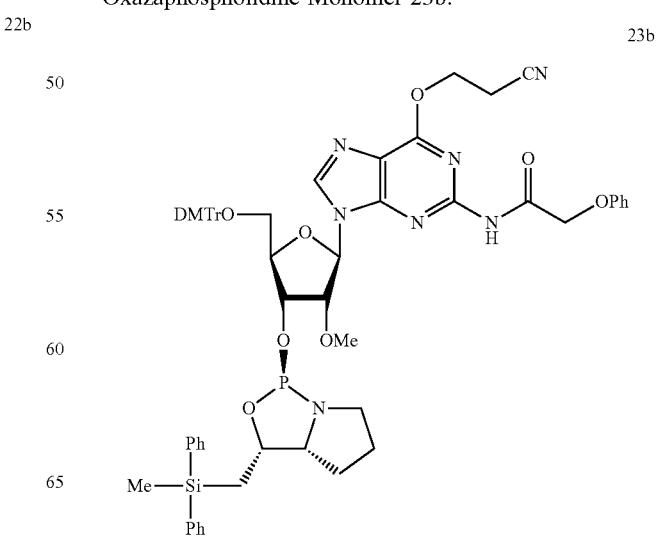

23b

Compound 23b was obtained by using 3b instead of 3a in a similar manner to compound 23a. ¹H NMR (300 MHz, CDCl₃) δ 8.74 (1H, brs), 8.09 (1H, s), 7.56-6.94 (24H, m), 6.84-6.71 (4H, m), 6.09 (1H, d, J=4.8 Hz), 4.83-4.70 (2H, m), 4.83 (2H, t, J=6.6 Hz), 4.63 (2H, brs), 4.35 (1H, t, J=5.0 Hz), 4.23-4.16 (1H, m), 3.75 (6H, s), 3.58-3.19 (4H, m), 3.32 (3H, s), 3.16-3.04 (1H, m), 3.07 (2H, t, J=6.6 Hz), 1.90-1.55 (3H, m), 1.48-1.15 (3H, m), 0.64 (3H, s); ³¹P NMR (121.5 MHz, CDCl₃) δ 154.6 (1P, s).

Example Z-35

Oxazaphospholidine Monomer 24a.

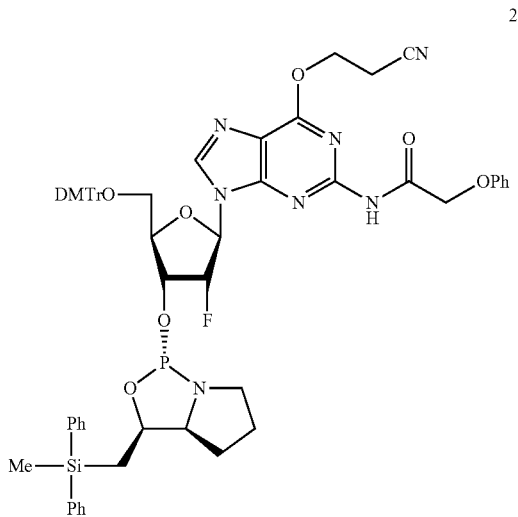

24a

Compound 24a was obtained by using "5'-O-(DMTr)-2'-deoxy-2'-fluoro-2-N-(phenoxyacetyl)-6-O-(cyanoethyl)guanosine" instead of "5'-O-(DMTr)-2-N-(phenoxyacetyl)-6-O-(cyanoethyl)guanosine" in a similar manner to compound 12a. ¹H NMR (300 MHz, CDCl₃) δ 8.74 (1H, brs), 8.03 (1H, s), 7.55-6.94 (24H, m), 6.80-6.69 (4H, m), 6.21 (1H, dd, J=14.9, 3.6 Hz), 5.34 (1H, dt, J=52.3, 3.6 Hz), 5.01-4.75 (2H, m), 4.84 (1H, t, J=6.6 Hz), 4.62 (2H, brs), 4.15-4.07 (1H, m), 3.73 (6H, s), 3.59-3.29 (4H, m), 3.15-3.00 (1H, m), 3.07 (2H, t, J=6.6 Hz), 1.90-1.49 (3H, m), 1.47-1.12 (3H, m), 0.58 (3H, s); ³¹P NMR (121.5 MHz, CDCl₃) δ 155.6 (1P, d, J=10.9 Hz).

Example Z-36

Oxazaphospholidine Monomer 24b.

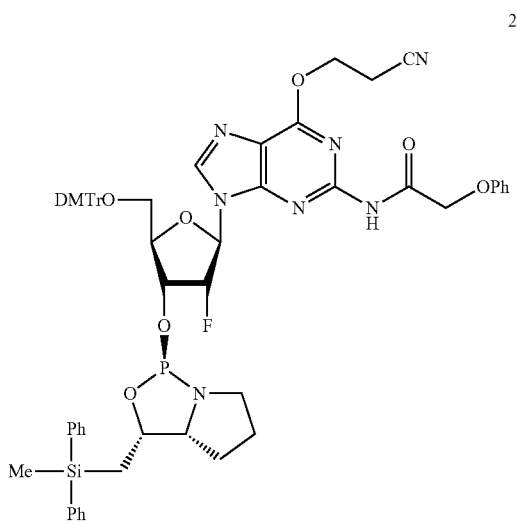

24b

Compound 24b was obtained by using 3b instead of 3a in a similar manner to compound 24a. ¹H NMR (300 MHz, CDCl₃) δ 8.81 (1H, brs), 8.06 (1H, s), 7.55-6.95 (24H, m), 6.77-6.69 (4H, m), 6.06 (1H, d, J=17.1 Hz), 5.24-5.08 (1H, m), 5.04-4.80 (2H, m), 4.87 (1H, t, J=6.6 Hz), 4.62 (2H, brs), 4.25-4.19 (1H, m), 3.73 (6H, s), 3.58-3.02 (5H, m), 3.10 (2H, t, J=6.6 Hz), 1.90-1.56 (3H, m), 1.50-1.15 (3H, m), 0.63 (3H, s); ³¹P NMR (121.5 MHz, CDCl₃) δ 158.0 (1P, d, J=4.4 Hz).

Example Z-37

Oxazaphospholidine Monomer 25a.

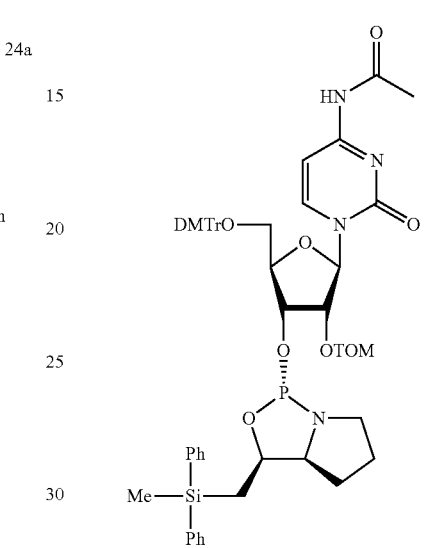

25a

Compound 25a was obtained by using "5'-O-(DMTr)-2'-O-TOM-4-N-(acetyl)cytidine" instead of "5'-O-(DMTr)-2-N-(phenoxyacetyl)-6-O-(cyanoethyl)guanosine" in a similar manner to compound 12a. ¹H NMR (300 MHz, CDCl₃) δ 10.04 (1H, brs), 8.30 (1H, d, J=7.5 Hz), 7.51-7.21 (19H, m), 6.99 (1H, d, J=7.5 Hz), 6.89-6.81 (4H, m), 6.12 (1H, d, J=3.3 Hz), 5.07 (1H, d, J=4.8 Hz), 5.05 (1H, d, J=4.8 Hz), 4.84-4.75 (1H, m), 4.62-4.52 (1H, m), 4.31-4.25 (1H, m), 4.08-4.01 (1H, m), 3.78 (6H, d, J=3.0 Hz), 3.55-3.23 (4H, m), 3.10-2.96 (1H, m), 2.24 (3H, s), 1.84-1.49 (3H, m), 1.46-0.96 (24H, m), 0.58 (3H, s); ³¹P NMR (121.5 MHz, CDCl₃) δ 156.5 (1P, s).

Example Z-38

Oxazaphospholidine Monomer 25b.

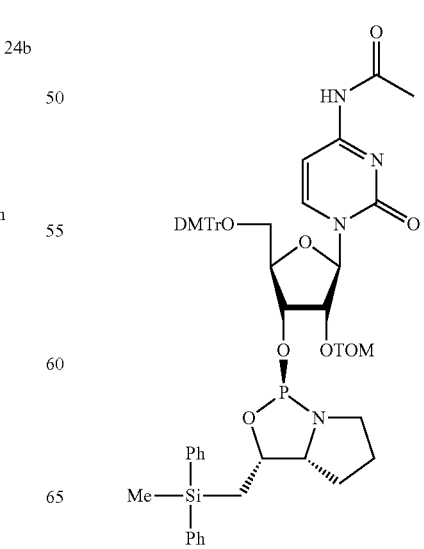

25b

Compound 25b was obtained by using 3b instead of 3a in a similar manner to compound 25a. $^1$H NMR (300 MHz, CDCl$_3$) δ 10.19 (1H, brs), 8.46 (1H, d, J=7.5 Hz), 7.54-7.23 (19H, m), 7.01 (1H, d, J=7.5 Hz), 6.88-6.79 (4H, m), 6.19 (1H, d, J=1.8 Hz), 5.11 (1H, d, J=4.8 Hz), 5.07 (1H, d, J=4.8 Hz), 4.81-4.71 (1H, m), 4.60-4.51 (1H, m), 4.26-4.18 (2H, m), 3.79 (6H, s), 3.63-3.55 (1H, m), 3.48-3.28 (2H, m), 3.21-2.94 (2H, m), 2.26 (3H, s), 1.81-1.49 (3H, m), 1.43-0.96 (24H, m), 0.62 (3H, s); $^{31}$P NMR (121.5 MHz, CDCl$_3$) δ 156.4 (1P, s).

Example Z-39

Oxazaphospholidine Monomer 26a.

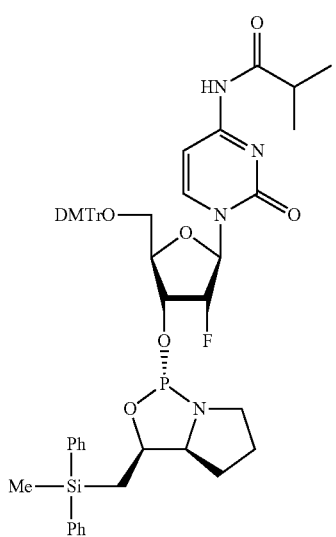

26a

Compound 26a was obtained by using "5'-O-(DMTr)-2'-deoxy-2'-fluoro-4-N-(isobutyryl)cytidine" instead of "5'-O-(DMTr)-2-N-(phenoxyacetyl)-6-O-(cyanoethyl)guanosine" in a similar manner to compound 12a. $^1$H NMR (300 MHz, CDCl$_3$) δ 8.66 (1H, brs), 8.41 (1H, d, J=7.5 Hz), 7.55-7.20 (19H, m), 7.01 (1H, d, J=7.5 Hz), 6.89-6.81 (4H, m), 6.06 (1H, d, J=15.9 Hz), 4.85 (1H, dd, J=51.4, 3.9 Hz), 4.84 (1H, dd, J=12.9, 7.5 Hz), 4.77-4.59 (1H, m), 4.15-4.08 (1H, m), 3.79 (6H, s), 3.63-3.29 (4H, m), 3.10-2.96 (1H, m), 2.65 (1H, septet, J=6.9 Hz), 1.85-1.53 (3H, m), 1.48-1.17 (3H, m), 1.21 (3H, d, J=4.8 Hz), 1.19 (3H, d, J=4.8 Hz), 0.59 (3H, s); $^{31}$P NMR (121.5 MHz, CDCl$_3$) δ 155.5 (1P, d, J=6.6 Hz).

Example Z-40

Oxazaphospholidine Monomer 26b.

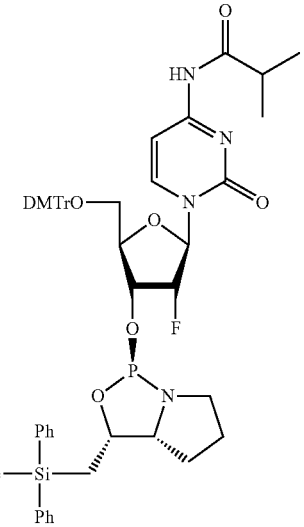

26b

Compound 26b was obtained by using 3b instead of 3a in a similar manner to compound 26a. $^1$H NMR (300 MHz, CDCl$_3$) δ 8.53 (1H, d, J=7.5 Hz), 7.57-7.23 (20H, m), 7.10 (1H, d, J=7.5 Hz), 6.89-6.81 (4H, m), 6.10 (1H, d, J=15.9 Hz), 5.00-4.92 (1H, m), 4.84 (1H, dd, J=51.5, 3.3 Hz), 4.75-4.58 (1H, m), 4.24 (1H, d, J=9.3 Hz), 3.81 (6H, s), 3.65-3.39 (3H, m), 3.32-3.06 (2H, m), 2.59 (1H, septet, J=6.9 Hz), 1.88-1.53 (4H, m), 1.49-1.34 (2H, m), 1.27-1.18 (6H, m), 0.65 (3H, s); $^{31}$P NMR (121.5 MHz, CDCl$_3$) δ 159.0 (1P, d, J=4.4).

Oxazaphospholidine Monomer 27a

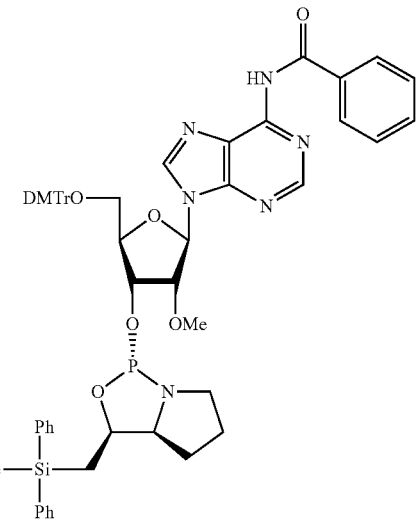

27a

Compound 27a was obtained by using "5'-O-(DMTr)-2'-O-methyl-6-N-(benzoyl)adenosine" instead of "5'-O-(DMTr)-2-N-(phenoxyacetyl)-6-O-(cyanoethyl)guanosine" in a similar manner to compound 12a.

$^1$H NMR (300 MHz, CDCl$_3$) δ 8.66 (1H, s), 8.13 (1H, s), 8.03 (2H, d, J=7.2 Hz), 7.64-7.16 (23H, m), 6.79 (4H, d,

J=8.7 Hz), 6.08 (1H, d, J=6.3 Hz), 4.91-4.81 (1H, m), 4.77-4.69 (1H, m), 4.64-4.57 (1H, m), 4.15-4.10 (1H, m), 3.76 (6H, s), 3.60-3.23 (4H, m), 3.35 (3H, s), 3.14-3.00 (1H, m), 1.90-1.19 (6H, m), 0.62 (3H, s); $^{31}$P NMR (121.5 MHz, CDCl$_3$) δ 155.8 (1P, s).

Oxazaphospholidine Monomer 27b.

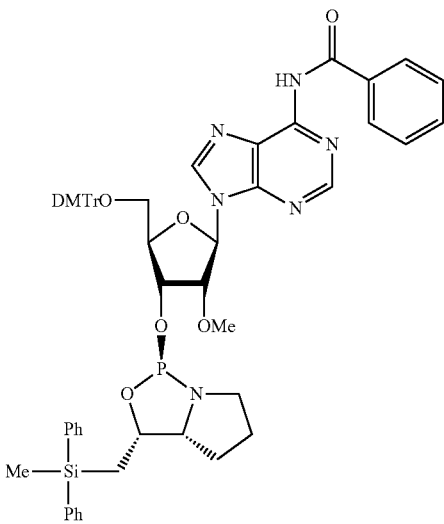

Compound 27b was obtained by using 3b instead of 3a in a similar manner to compound 27a.

$^1$H NMR (300 MHz, CDCl$_3$) δ 9.12 (1H, brs), 8.73 (1H, s), 8.24 (1H, s), 8.07-8.01 (2H, m), 7.62-7.17 (22H, m), 6.83-6.77 (4H, m), 6.12 (1H, d, J=4.8 Hz), 4.84-4.73 (2H, m), 4.43 (1H, t, J=4.8 Hz), 4.25-4.19 (1H, m), 3.77 (6H, s), 3.55-3.20 (4H, m), 3.28 (3H, s), 3.16-3.03 (1H, m), 1.90-1.17 (6H, m), 0.65 (3H, s); $^{31}$P NMR (121.5 MHz, CDCl$_3$) δ 155.0 (1P, s).

Oxazaphospholidine Monomer 28a.

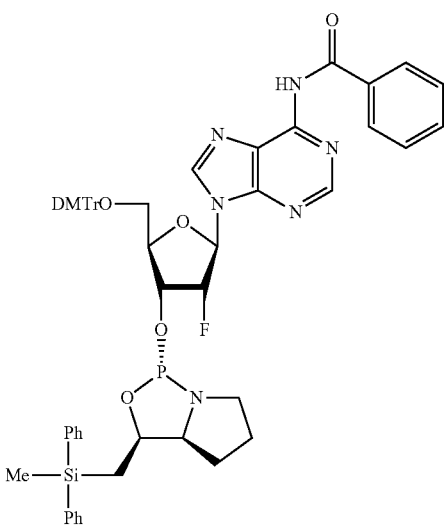

Compound 28a was obtained by using "5'-O-(DMTr)-2'-deoxy-2'-fluoro-6-N-(benzoyl)adenosine" instead of "5'-O-(DMTr)-2-N-(phenoxyacetyl)-6-O-(cyanoethyl)guanosine" in a similar manner to compound 12a.

$^1$H NMR (300 MHz, CDCl$_3$) δ 8.64 (1H, s), 8.14 (1H, s), 8.06-8.01 (2H, m), 7.63-7.07 (23H, m), 6.78-6.70 (4H, m), 6.12 (1H, dd, J=18.0, 2.4 Hz), 5.24-5.01 (2H, m), 4.94-4.84 (1H, m), 4.17-4.06 (1H, m), 3.73 (6H, s), 3.55-3.40 (3H, m), 3.30-3.22 (1H, m), 3.03-2.88 (1H, m), 1.92-1.19 (6H, m), 0.62 (3H, s); $^{31}$P NMR (121.5 MHz, CDCl$_3$) δ 150.5 (1P, d, J=7.7 Hz).

Oxazaphospholidine Monomer 28b.

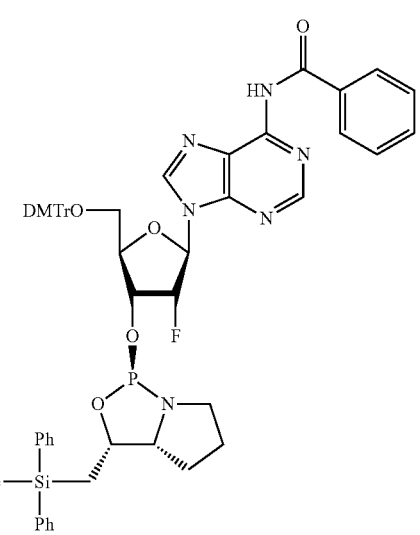

Compound 28b was obtained by using 3b instead of 3a in a similar manner to compound 28a.

$^1$H NMR (300 MHz, CDCl$_3$) δ 9.07 (1H, brs), 8.80 (1H, s), 8.24 (1H, s), 8.08-8.01 (2H, m), 7.66-7.15 (22H, m), 6.81-6.75 (4H, m), 6.14 (1H, dd, J=18.0, 1.8 Hz), 5.16-4.91 (3H, m), 4.28-4.21 (1H, m), 3.76 (6H, s), 3.57-3.11 (5H, m), 1.82-1.16 (6H, m), 0.65 (3H, s); $^{31}$P NMR (121.5 MHz, CDCl$_3$) δ 157.8 (1P, d, J=5.6 Hz).

Oxazaphospholidine Monomer 29a.

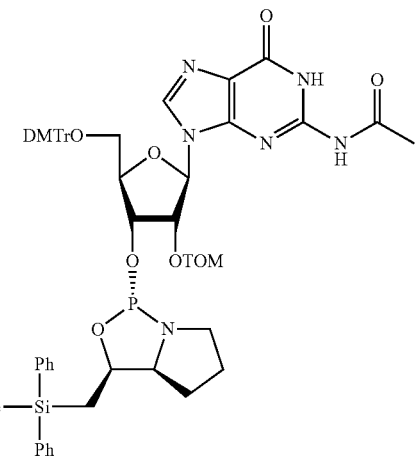

Compound 29a was obtained by using "5'-O-(DMTr)-2'-O-TOM-2-N-(acetyl)guanosine" instead of "5'-O-(DMTr)-2-N-(phenoxyacetyl)-6-O-(cyanoethyl)guanosine" in a similar manner to compound 12a.

¹H NMR (300 MHz, CDCl₃) δ 7.70 (1H, s), 7.63-7.13 (21H, m), 6.84-6.76 (4H, m), 5.77 (1H, d, J=8.4 Hz), 5.41-5.33 (1H, m), 4.90 (2H, s), 4.78-4.68 (2H, m), 3.86 (1H, brs), 3.75 (3H, s), 3.74 (3H, s), 3.56-3.41 (2H, m), 3.32-2.90 (3H, m), 1.92-1.10 (9H, m), 0.97-0.87 (21H, m), 0.52 (3H, s); ³¹P NMR (121.5 MHz, CDCl₃) δ 158.1 (1P, s).

Oxazaphospholidine Monomer 29b.

(1H, d, J=5.1 Hz), 4.84-4.75 (1H, m), 4.54-4.46 (1H, m), 4.38 (1H, t, J=5.7 Hz), 3.87-3.83 (1H, m), 3.78 (3H, s), 3.77 (3H, s), 3.56-3.42 (1H, m), 3.39-3.28 (1H, m), 3.36 (1H, dd, J=11.0, 2.7 Hz), 3.25 (1H, dd, J=11.0, 2.7 Hz), 3.16-3.03 (1H, m), 1.88-1.12 (6H, m), 1.08-0.97 (21H, m), 0.59 (3H, s); ³¹P NMR (121.5 MHz, CDCl₃) δ 156.6 (1P, s).

Oxazaphospholidine Monomer 30b.

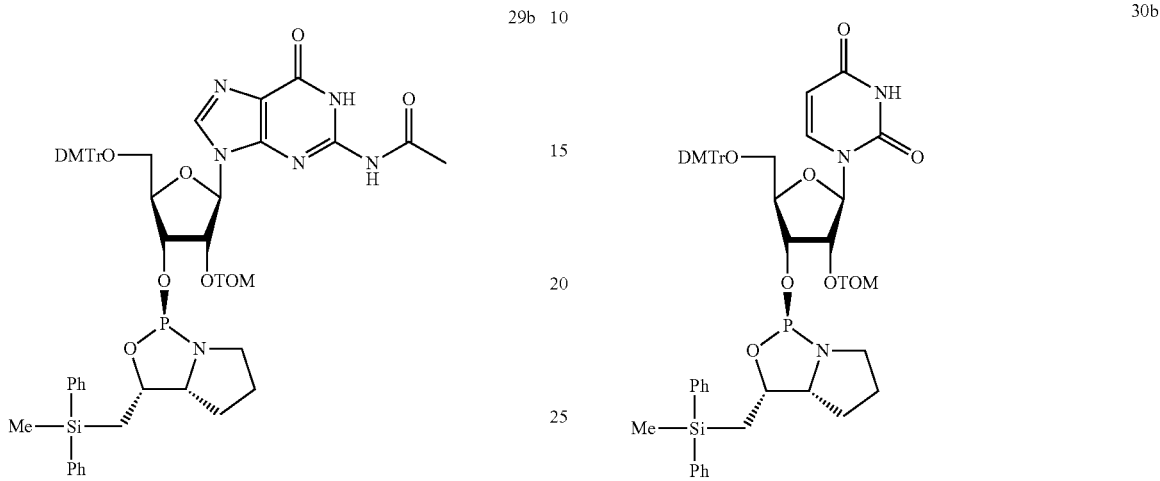

Compound 29b was obtained by using 3b instead of 3a in a similar manner to compound 29a.

¹H NMR (300 MHz, CDCl₃) δ 7.77 (1H, s), 7.56-7.15 (21H, m), 6.82-6.75 (4H, m), 5.86 (1H, d, J=7.5 Hz), 5.26-5.17 (1H, m), 4.95 (1H, d, J=5.4 Hz), 4.85 (1H, d, J=5.4 Hz), 4.78-4.71 (1H, m), 4.59-4.49 (1H, m), 4.10-4.05 (1H, m), 3.74 (6H, s), 3.52-3.37 (2H, m), 3.30-3.18 (1H, m), 3.11-2.85 (2H, m), 1.85-1.15 (9H, m), 0.93-0.84 (21H, m), 0.62 (3H, s); ³¹P NMR (121.5 MHz, CDCl₃) δ 152.3 (1P, s).

Oxazaphospholidine Monomer 30a.

Compound 30b was obtained by using 3b instead of 3a in a similar manner to compound 30a.

¹H NMR (600 MHz, CDCl₃) δ 7.87 (1H, d, J=7.8 Hz), 7.52-7.48 (4H, m), 7.38-7.21 (16H, m), 6.83-6.79 (4H, m), 6.14 (1H, d, J=4.8 Hz), 5.33 (1H, d, J=7.8 Hz), 4.99 (1H, d, J=5.4 Hz), 4.89 (1H, d, J=5.4 Hz), 4.67 (1H, dd, J=13.8, 7.2 Hz), 4.52 (1H, dt, J=10.4, 4.8 Hz), 4.31 (1H, t, J=4.8 Hz), 4.06-4.03 (1H, m), 3.78 (3H, s), 3.77 (3H, s), 3.47 (1H, dd, J=10.4, 2.4 Hz), 3.47-3.39 (1H, m), 3.22-3.17 (2H, m), 3.00 (1H, ddd, J=19.5, 10.4, 4.8 Hz), 1.82-1.74 (1H, m), 1.68-1.58 (1H, m), 1.56 (1H, dd, J=14.4, 8.4 Hz), 1.38 (1H, dd, J=14.4, 7.2 Hz), 1.31-1.25 (1H, m), 1.26-1.17 (1H, m), 1.08-0.98 (21H, m), 0.63 (3H, s); ³¹P NMR (243.0 MHz, CDCl₃) δ 154.3 (1P, s).

Oxazaphospholidine Monomer 31a.

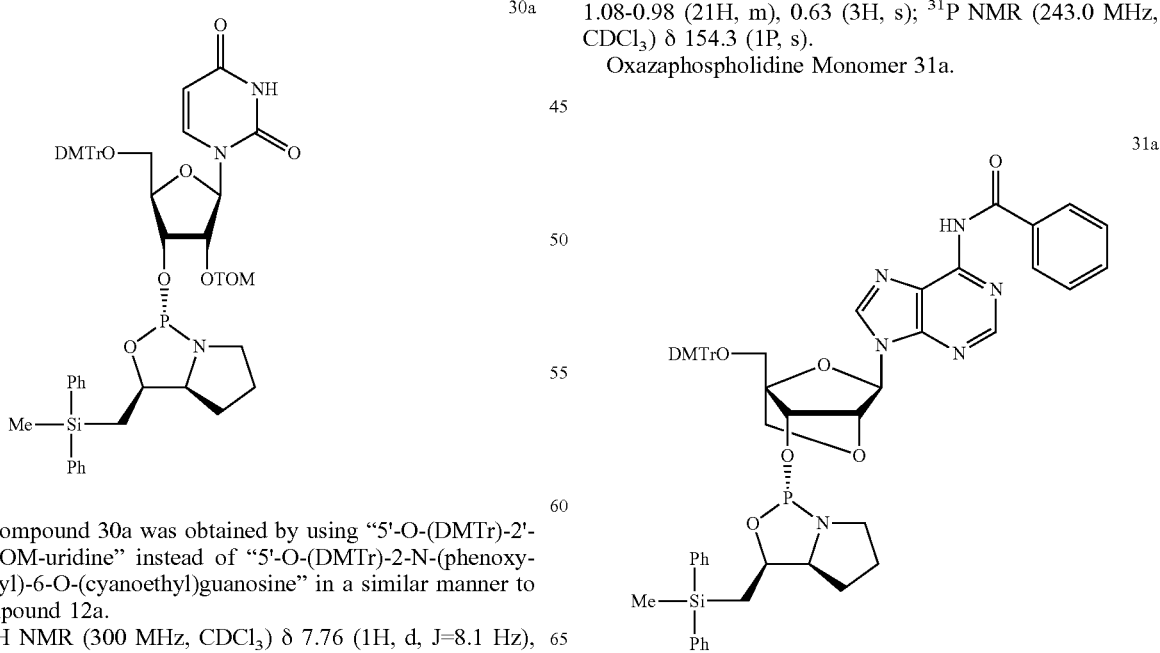

Compound 30a was obtained by using "5'-O-(DMTr)-2'-O-TOM-uridine" instead of "5'-O-(DMTr)-2-N-(phenoxyacetyl)-6-O-(cyanoethyl)guanosine" in a similar manner to compound 12a.

¹H NMR (300 MHz, CDCl₃) δ 7.76 (1H, d, J=8.1 Hz), 7.55-7.18 (20H, m), 6.88-6.80 (4H, m), 6.11 (1H, d, J=6.0 Hz), 5.32 (1H, d, J=8.1 Hz), 4.99 (1H, d, J=5.1 Hz), 4.93

Compound 31a was obtained by using "5'-O-(DMTr)-2'-O,4'-C-methylene-6-N-(benzoyl)adenosine" instead of "5'-O-(DMTr)-2-N-(phenoxyacetyl)-6-O-(cyanoethyl)guanosine" in a similar manner to compound 12a.

$^1$H NMR (300 MHz, CDCl$_3$) δ 9.10 (1H, brs), 8.76 (1H, s), 8.32 (1H, s), 8.04 (2H, d, J=7.2 Hz), 7.64-7.18 (22H, m), 6.84 (4H, d, J=8.7 Hz), 6.10 (1H, s), 4.76 (1H, d J=6.9 Hz), 4.58 (1H, s), 4.61-4.51 (1H, m), 3.91 (1H, d, J=7.8 Hz), 3.77 (1H, d, J=7.8 Hz), 3.75 (6H, s), 3.50 (1H, s), 3.47-3.33 (1H, m), 3.31-3.19 (1H, m), 3.03-2.88 (1H, m), 1.84-1.09 (6H, m), 0.51 (3H, s); $^{31}$P NMR (121.5 MHz, CDCl$_3$) δ 152.9 (1P, s).

Oxazaphospholidine Monomer 31b.

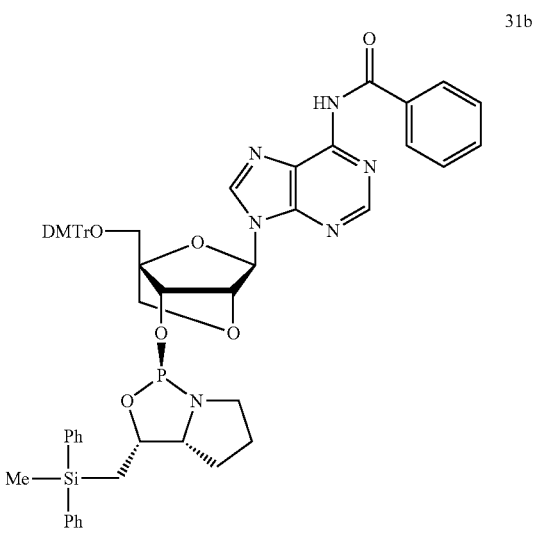

31b

Compound 31b was obtained by using 3b instead of 3a in a similar manner to compound 31a.

$^1$H NMR (300 MHz, CDCl$_3$) δ 8.81 (1H, s), 8.30 (1H, s), 8.07-8.00 (2H, m), 7.64-7.17 (22H, m), 6.86-6.79 (4H, m), 6.12 (1H, s), 4.81-4.72 (1H, m), 4.62 (1H, d J=7.2 Hz), 4.57 (1H, s), 3.94 (1H, d, J=7.8 Hz), 3.89 (1H, d, J=7.8 Hz), 3.77 (6H, s), 3.48 (2H, s), 3.46-3.32 (1H, m), 3.24-3.13 (1H, m), 3.10-2.97 (1H, m), 1.84-1.49 (3H, m), 1.42-1.09 (3H, m), 0.58 (3H, s); $^{31}$P NMR (121.5 MHz, CDCl$_3$) δ 157.3 (1P, s).

Oxazaphospholidine Monomer 32a.

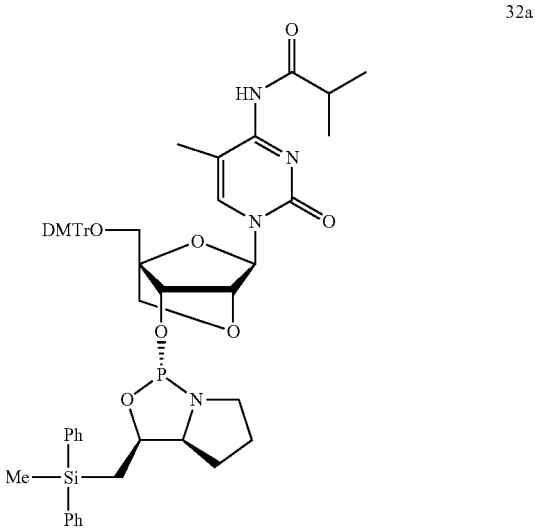

32a

Compound 32a was obtained by using "5'-O-(DMTr)-2'-O,4'-C-methylene-4-N-(isobutyryl)-5-methylcytidine" instead of "5'-O-(DMTr)-2-N-(phenoxyacetyl)-6-O-(cyanoethyl)guanosine" in a similar manner to compound 12a.

$^1$H NMR (300 MHz, CDCl$_3$) δ 7.88 (1H, brs), 7.58-7.18 (20H, m), 6.88-6.80 (4H, m), 5.65 (1H, s), 4.69-4.60 (1H, m), 4.52 (1H, d, J=6.6 Hz), 4.49 (1H, s), 3.81-3.74 (1H, m), 3.75 (3H, s), 3.73 (3H, s), 3.64 (1H, d, J=8.1 Hz), 3.56 (1H, d, J=11.1 Hz), 3.53 (1H, d, J=8.1 Hz), 3.46 (1H, d, J=11.1 Hz), 3.56-3.40 (1H, m), 3.32-3.20 (1H, m), 3.14-3.00 (1H, m), 1.85-1.12 (6H, m), 1.60 (3H, s), 1.19 (6H, d, J=6.9 Hz), 0.55 (3H, s); $^{31}$P NMR (121.5 MHz, CDCl$_3$) δ 155.9 (1P, s).

Oxazaphospholidine Monomer 32b.

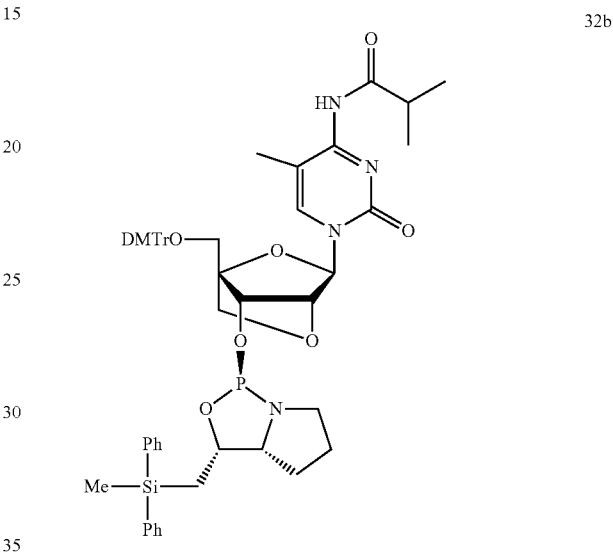

32b

Compound 32b was obtained by using 3b instead of 3a in a similar manner to compound 32a.

$^1$H NMR (300 MHz, CDCl$_3$) δ 7.86 (1H, brs), 7.56-7.19 (20H, m), 6.88-6.79 (4H, m), 5.69 (1H, s), 4.86-4.76 (1H, m), 4.46 (1H, s), 4.45 (1H, d, J=7.5 Hz), 3.80-3.75 (1H, m), 3.79 (6H, s), 3.74 (1H, d, J=8.1 Hz), 3.69 (1H, d, J=8.1 Hz), 3.51 (1H, d, J=11.1 Hz), 3.44-3.30 (1H, m), 3.39 (1H, d, J=11.1 Hz), 3.29-3.17 (1H, m), 3.11-2.97 (1H, m), 1.86-1.52 (3H, m), 1.64 (3H, s), 1.45-1.10 (3H, m), 1.21 (6H, d, J=6.6 Hz), 0.62 (3H, s); $^{31}$P NMR (121.5 MHz, CDCl$_3$) δ 158.2 (1P, s).

Oxazaphospholidine Monomer 33a.

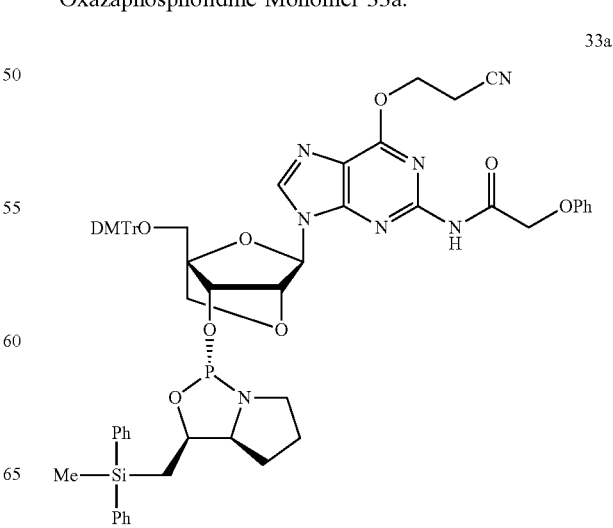

33a

Compound 33a was obtained by using "5'-O-(DMTr)-2'-O,4'-C-methylene-2-N-(phenoxyacetyl)-6-O-(cyanoethyl)guanosine" instead of "5'-O-(DMTr)-2-N-(phenoxyacetyl)-6-O-(cyanoethyl)guanosine" in a similar manner to compound 12a.

$^1$H NMR (300 MHz, CDCl$_3$) δ 8.71 (1H, brs), 8.16 (1H, s), 7.50-7.17 (21H, m), 7.09-7.01 (3H, m), 6.86-6.79 (4H, m), 6.03 (1H, s), 4.84 (2H, t, J=6.6 Hz), 4.72 (2H, s), 4.68 (1H, d, J=7.2 Hz), 4.55-4.46 (1H, m), 4.50 (1H, s), 3.90 (1H, d, J=7.8 Hz), 3.77 (1H, d, J=7.8 Hz), 3.75 (6H, s), 3.51 (1H, d, J=10.8 Hz), 3.47 (1H, d, J=10.8 Hz), 3.45-3.21 (2H, m), 3.08 (2H, t, J=6.6 Hz), 3.03-2.89 (1H, m), 1.80-1.08 (6H, m), 0.47 (3H, s); $^{31}$P NMR (121.5 MHz, CDCl$_3$) δ 153.2 (1P, s).

Oxazaphospholidine Monomer 33b.

Compound 34a was obtained by using "5'-O-(DMTr)-2'-O,4'-C-methylene-5-methyluridine" instead of "5'-O-(DMTr)-2-N-(phenoxyacetyl)-6-O-(cyanoethyl)guanosine" in a similar manner to compound 12a.

$^1$H NMR (300 MHz, CDCl$_3$) δ 7.71 (1H, d, J=0.9 Hz), 7.50-7.17 (20H, m), 6.87-6.80 (4H, m), 5.61 (1H, s), 4.69-4.60 (1H, m), 4.55 (1H, d, J=6.9 Hz), 4.41 (1H, s), 3.74 (3H, s), 3.73 (3H, s), 3.64 (1H, d, J=7.8 Hz), 3.55 (1H, d, J=7.8 Hz), 3.53 (1H, d, J=10.8 Hz), 3.46 (1H, d, J=10.8 Hz), 3.56-3.42 (1H, m), 3.35-3.24 (1H, m), 3.13-3.00 (1H, m), 1.85-1.45 (3H, m), 1.55 (3H, d, J=0.9 Hz), 1.41-1.12 (3H, m), 0.56 (3H, s); $^{31}$P NMR (121.5 MHz, CDCl$_3$) δ 155.1 (1P, s).

Oxazaphospholidine Monomer 34b.

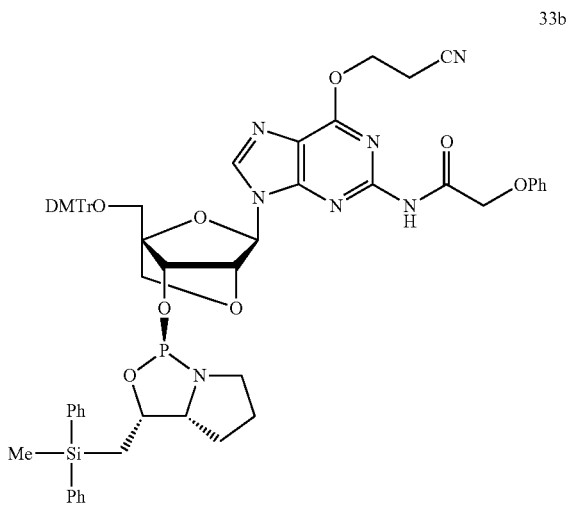

33b

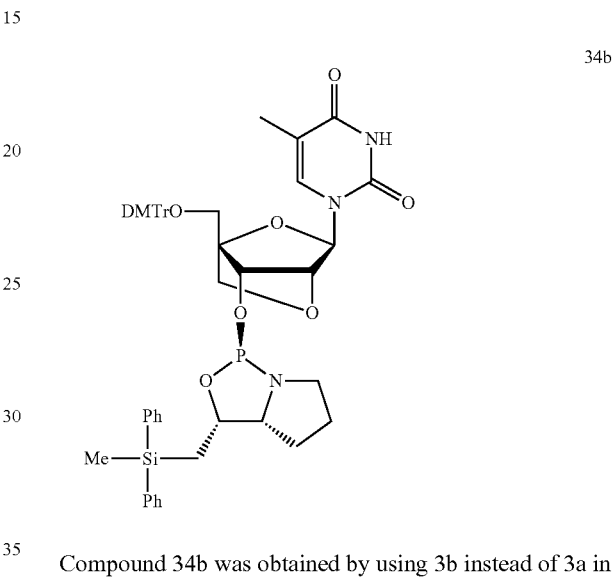

34b

Compound 33b was obtained by using 3b instead of 3a in a similar manner to compound 33a.

$^1$H NMR (300 MHz, CDCl$_3$) δ 8.86 (1H, brs), 8.13 (1H, s), 7.55-7.17 (21H, m), 7.08-6.98 (3H, m), 6.95-6.78 (4H, m), 6.01 (1H, s), 4.86 (2H, t, J=6.6 Hz), 4.82-4.73 (1H, m), 4.70 (2H, s), 4.64 (1H, d, J=7.5 Hz), 4.49 (1H, s), 3.94 (1H, d, 0.1=7.8 Hz), 3.89 (1H, d, J=7.8 Hz), 3.77 (6H, s), 3.46 (2H, s), 3.45-3.30 (1H, m), 3.24-3.12 (1H, m), 3.09 (2H, t, J=6.6 Hz), 3.09-2.96 (1H, m), 1.81-1.50 (3H, m), 1.41-1.06 (3H, m), 0.58 (3H, s); $^{31}$P NMR (121.5 MHz, CDCl$_3$) δ 157.4 (1P, s).

Oxazaphospholidine Monomer 34a.

Compound 34b was obtained by using 3b instead of 3a in a similar manner to compound 34a.

$^1$H NMR (300 MHz, CDCl$_3$) δ 7.69 (1H, s), 7.56-7.19 (20H, m), 6.88-6.79 (4H, m), 5.66 (1H, s), 4.87-4.77 (1H, m), 4.47 (1H, d, J=7.8 Hz), 4.40 (1H, s), 3.78 (6H, s), 3.74 (1H, d, J=7.8 Hz), 3.68 (1H, d, J=7.8 Hz), 3.50 (1H, d, J=10.8 Hz), 3.46-3.32 (1H, m), 3.39 (1H, d, J=10.8 Hz), 3.30-3.19 (1H, m), 3.12-2.98 (1H, m), 1.85-1.56 (3H, m), 1.59 (3H, s), 1.46-1.12 (3H, m), 0.63 (3H, s); $^{31}$P NMR (121.5 MHz, CDCl$_3$) δ 158.1 (1P, s).

Oxazaphospholidine Monomer 35a.

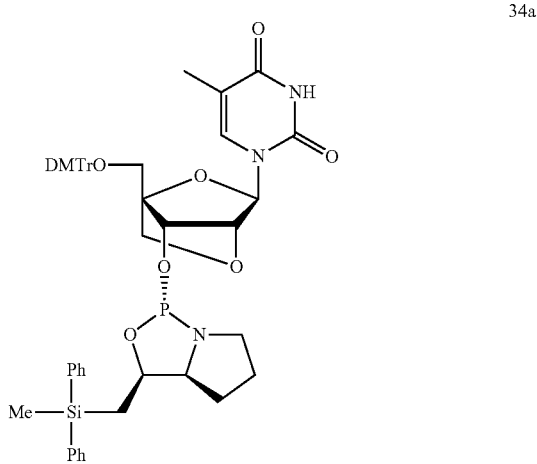

34a

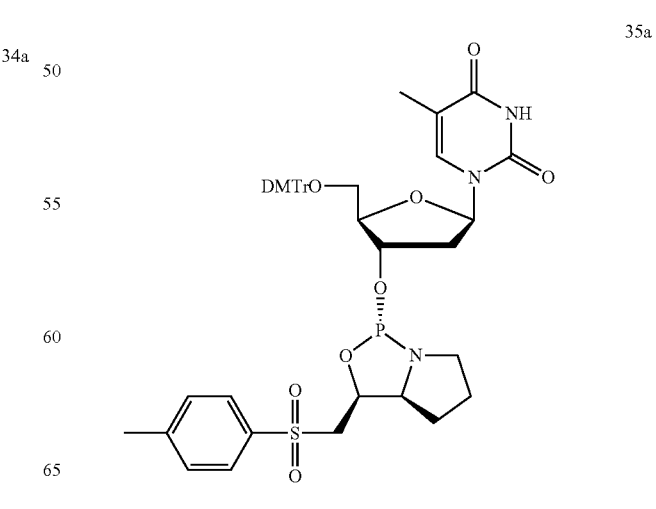

35a

Compound 35a was obtained by using 13a' instead of 3a in a similar manner to compound 13a. $^1$H NMR (600 MHz, CDCl$_3$) δ 7.76 (2H, d, J=9.0 Hz), 7.62 (1H, d, J=1.2 Hz), 7.40 (2H, d, J=7.2 Hz), 7.32-7.23 (10H, m), 6.85 (4H, d, J=8.4 Hz), 6.41 (1H, dd, J=8.4, 5.4 Hz), 4.94 (1H, dd, J=12.3, 5.4 Hz), 4.84-4.79 (1H, m), 4.03-4.01 (1H, m), 3.79 (6H, s), 3.59-3.53 (1H, m), 3.52-3.44 (2H, m), 3.41 (1H, dd, J=14.7, 7.2 Hz), 3.37-3.30 (2H, m), 3.13 (1H, ddd, J=19.3, 10.3, 4.1 Hz), 2.50-2.44 (1H, m), 2.39 (3H, s), 2.35-2.29 (1H, m), 1.91-1.72 (2H, m), 1.64-1.59 (1H, m), 1.40 (3H, s), 1.12-1.05 (1H, m); $^{31}$P NMR (243.0 MHz, CDCl$_3$) δ 154.2 (1P, s).

Example Z-41

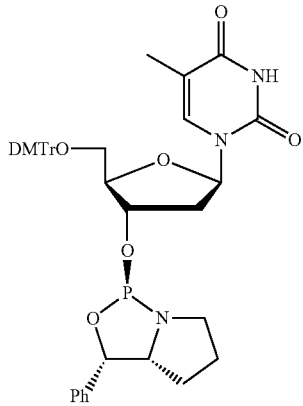

Z-27

Figure 69:
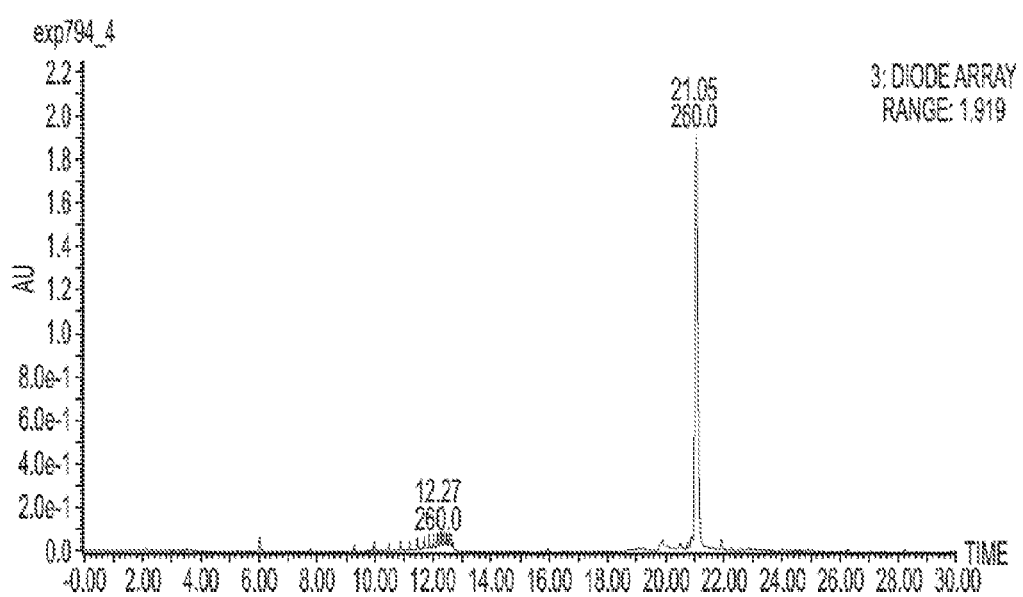
FIG. 69. UPLC profile in producing oligonucleotide derivative using the monomer of 13b.
Figure 70:
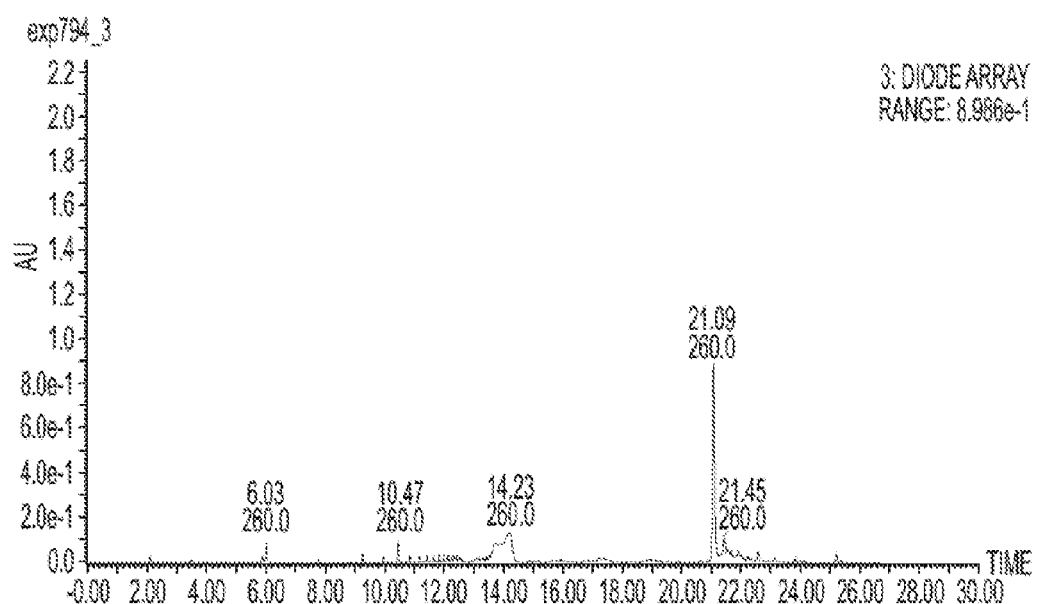
FIG. 70. UPLC profile in producing oligonucleotide derivative using the monomer of 27.

The above Compound Z-27, which represents a conventional monomer, was used to produce oligos. FIG. 70 shows a chart of products obtained through Comparison Example Z-1. As shown in FIGS. 69 and 70, the present monomers provided more complete deprotection and less side product, which makes product isolation and/or purification easier.

In some embodiments, the present invention provides chemically stable monomers. Exemplary such monomers are depicted in the Examples above. In some embodiments, the present invention provides monomers with high isolated yield. In some embodiments, the present invention provides monomers with isolated yield higher than conventional method. In some embodiments, the isolated yield is more than 80%. Exemplary such monomers are depicted in the Examples above.

Condensing Reagent

Condensing reagents (C$_R$) useful in accordance with methods of the present invention are of any one of the following general formulae:

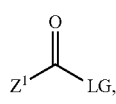

C$_R$1

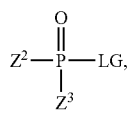

C$_R$2

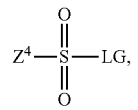

C$_R$3

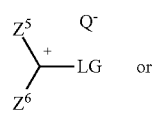

C$_R$4

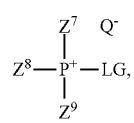

C$_R$5 wherein Z$^1$, Z$^2$, Z$^3$, Z$^4$, Z$^5$, Z$^6$, Z$^7$, Z$^8$, and Z$^9$ are independently optionally substituted group selected from alkyl, aminoalkyl, cycloalkyl, heterocyclic, cycloalkylalkyl, heterocycloalkyl, aryl, heteroaryl, alkyloxy, aryloxy, or heteroaryloxy, or wherein any of Z$^2$ and Z$^3$, Z$^5$ and Z$^6$, Z$^7$ and Z$^8$, Z$^8$ and Z$^9$, Z$^9$ and Z$^7$, or Z$^7$ and Z$^8$ and Z$^9$ are taken together to form a 3 to 20 membered alicyclic or heterocyclic ring; Q$^-$ is a counter anion; and LG is a leaving group.

In some embodiments, a counter ion of a condensing reagent C$_R$ is Cl$^-$, Br$^-$, BF$_4^-$, PF$_6^-$, TfO$^-$, Tf$_2$N$^-$, AsF$_6^-$, ClO$_4^-$, or SbF$_6^-$, wherein Tf is CF$_3$SO$_2$. In some embodiments, a leaving group of a condensing reagent C$_R$ is F, Cl, Br, I, 3-nitro-1,2,4-triazole, imidazole, alkyltriazole, tetrazole, pentafluorobenzene, or 1-hydroxybenzotriazole.

Examples of condensing reagents used in accordance with methods of the present invention include, but are not limited to, pentafluorobenzoyl chloride, carbonyldiimidazole (CDI), 1-mesitylenesulfonyl-3-nitrotriazole (MSNT), 1-ethyl-3-(3'-dimethylaminopropyl)carbodiimide hydrochloride (EDCI—HCl), benzotriazole-1-yloxytris(dimethylamino)phosphonium hexafluorophosphate (PyBOP), N,N'-bis(2-oxo-3-oxazolidinyl)phosphinic chloride (BopCl), 2-(1H-7-azabenzotriazol-1-yl)-1,1,3,3-tetramethyluronium hexafluorophosphate (HATU), and O-benzotriazole-N,N,N',N'-tetramethyluronium hexafluorophosphate (HBTU), DIP-CDI; N,N'-bis(2-oxo-3-oxazolidinyl)phosphinic bromide (BopBr); 1,3-dimethyl-2-(3-nitro-1,2,4-triazol-1-yl)-2-pyrrolidin-1-yl-1,3,2-diazaphospholidinium hexafluorophosphate (MNTP), 3-nitro-1,2,4-triazol-1-yl-tris(pyrrolidin-1-yl)phosphonium hexafluorophosphate (PyNTP), bromotripyrrolidinophosphonium hexafluorophosphate (Py-BrOP); O-(benzotriazol-1-yl)-N,N,N',N'-tetramethyluronium tetrafluoroborate (TBTU); and tetramethyl fluoroformamidinium hexafluorophosphate (TFFH). In certain embodiments, a counter ion of the condensing reagent C$_R$ is Cl$^-$, Br$^-$, BF$_4^-$, PF$_6^-$, TfO$^-$, Tf$_2$N$^-$, AsF$_6^-$, ClO$_4^-$, or SbF$_6^-$, wherein Tf is CF$_3$SO$_2$.

In some embodiments, a condensing reagent is 1-(2,4,6-triisopropylbenzenesulfonyl)-5-(pyridin-2-yl) tetrazolide, pivaloyl chloride, bromotrispyrrolidinophosphonium hexafluorophosphate, N,N'-bis(2-oxo-3-oxazolidinyl) phosphinic chloride (BopCl), or 2-chloro-5,5-dimethyl-2-oxo-1,3,2-dioxaphosphinane. In some embodiment, a condensing reagent is N,N'-bis(2-oxo-3-oxazolidinyl)phosphinic chloride (BopCl). In some embodiments, a condensing reagent is selected from those described in WO/2006/066260).

In some embodiments, a condensing reagent is 1,3-dimethyl-2-(3-nitro-1,2,4-triazol-1-yl)-2-pyrrolidin-1-yl-1,3,2-diazaphospholidinium hexafluorophosphate (MNTP), or 3-nitro-1,2,4-triazol-1-yl-tris(pyrrolidin-1-yl)phosphonium hexafluorophosphate (PyNTP):

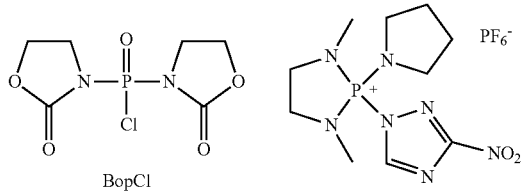

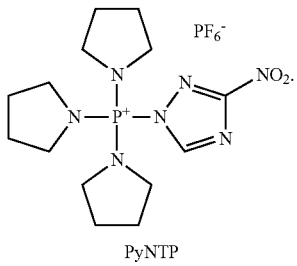

Selection of Base and Sugar of Nucleoside Coupling Partner

As described herein, nucleoside coupling partners for use in accordance with methods of the present invention can be the same as one another or can be different from one another. In some embodiments, nucleoside coupling partners for use in the synthesis of a provided oligonucleotide are of the same structure and/or stereochemical configuration as one another. In some embodiments, each nucleoside coupling partner for use in the synthesis of a provided oligonucleotide is not of the same structure and/or stereochemical configuration as certain other nucleoside coupling partners of the oligonucleotide. Exemplary nucleobases and sugars for use in accordance with methods of the present invention are described herein. One of skill in the relevant chemical and synthetic arts will recognize that any combination of nucleobases and sugars described herein are contemplated for use in accordance with methods of the present invention.

Coupling Step:

Exemplary coupling procedures and chiral reagents and condensing reagents for use in accordance with the present invention are outlined in, inter alia, Wada I (JP4348077; WO2005/014609; WO2005/092909), Wada II (WO2010/064146), and Wada III (WO2012/039448). Chiral nucleoside coupling partners for use in accordance with the present invention are also referred to herein as "Wada amidites." In some embodiments, a coupling partner has the structure of

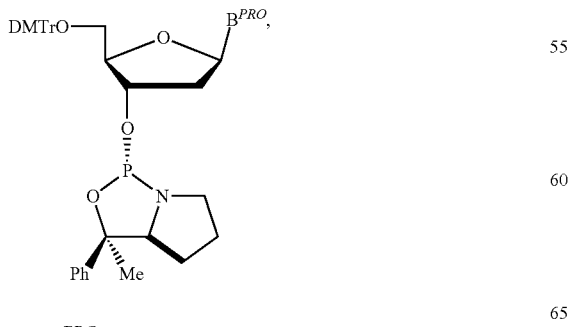

wherein $B^{PRO}$ is a protected nucleobase. In some embodiments, a coupling partner has the structure of

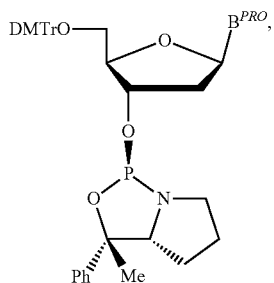

wherein $B^{PRO}$ is a protected nucleobase. Exemplary chiral phosphoramidites as coupling partner are depicted below:

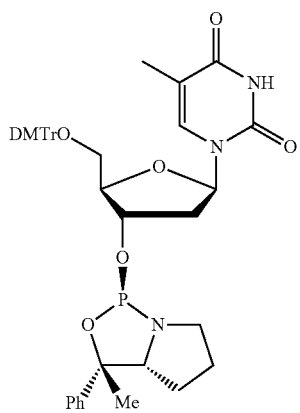

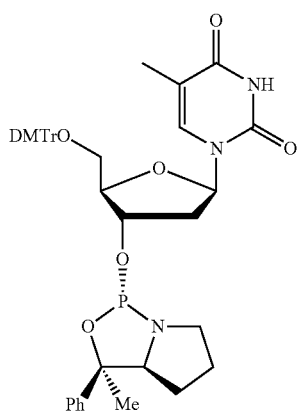

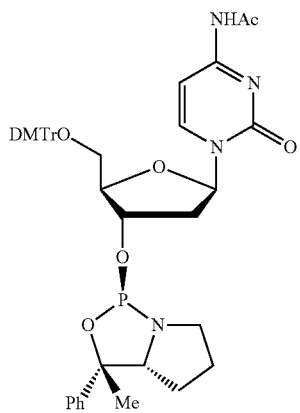

261
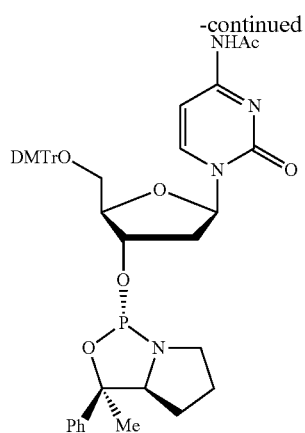
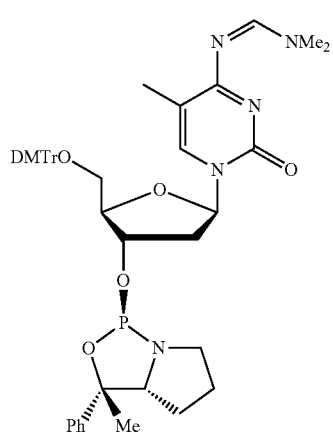
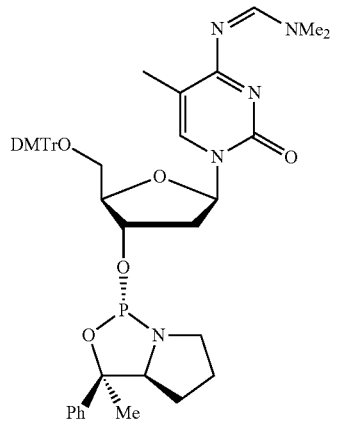
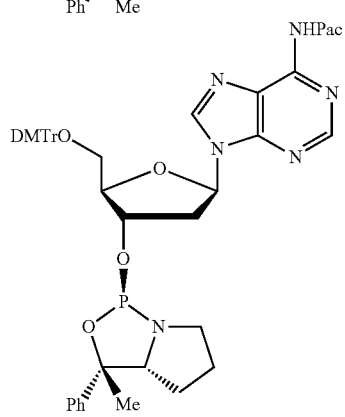
262
-continued
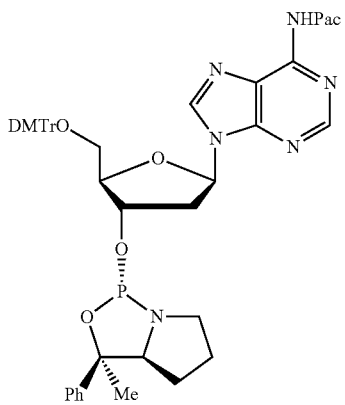
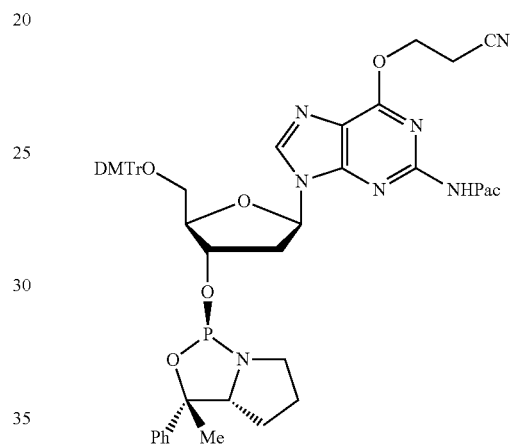
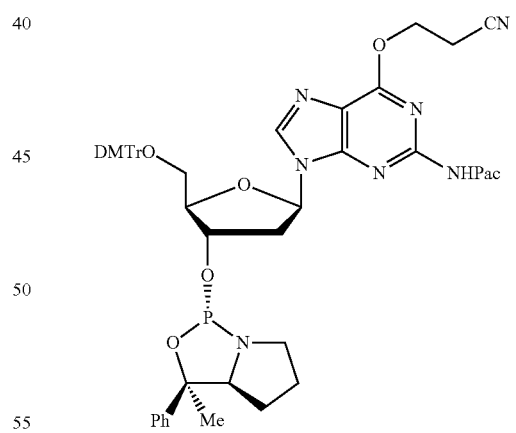
One of the methods used for synthesizing the coupling partner is depicted in Scheme II, below.
Scheme II. Exemplary synthesis of coupling partner.
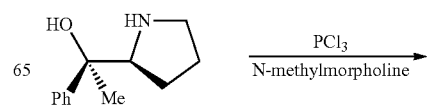

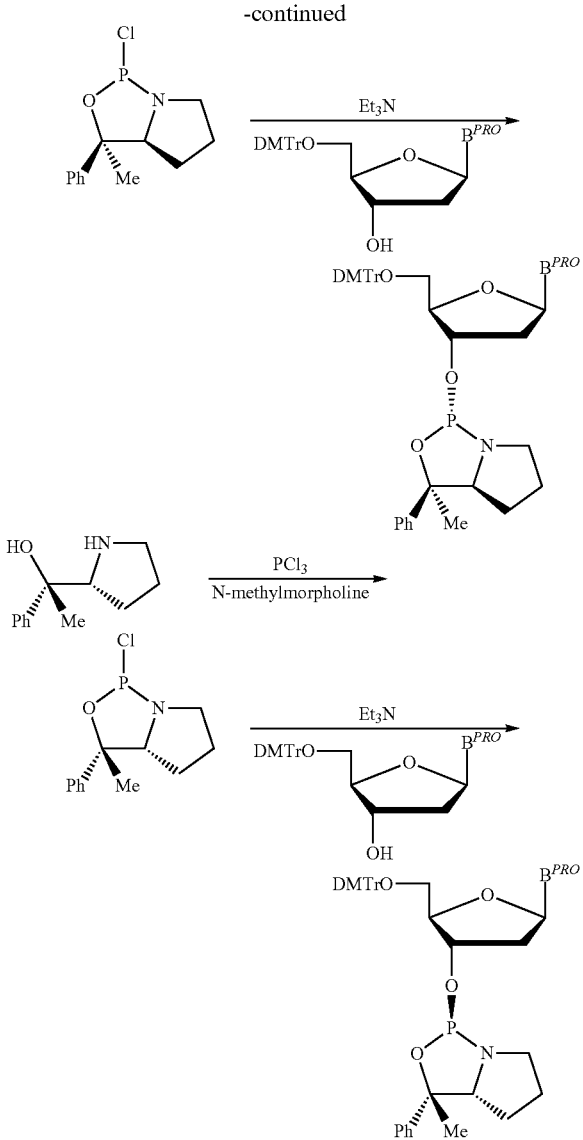

In some embodiments, the step of coupling comprises reacting a free hydroxyl group of a nucleotide unit of an oligonucleotide with a nucleoside coupling partner under suitable conditions to effect the coupling. In some embodiments, the step of coupling is preceded by a step of deblocking. For instance, in some embodiments, the 5' hydroxyl group of the growing oligonucleotide is blocked (i.e., protected) and must be deblocked in order to subsequently react with a nucleoside coupling partner.

Once the appropriate hydroxyl group of the growing oligonucleotide has been deblocked, the support is washed and dried in preparation for delivery of a solution comprising a chiral reagent and a solution comprising an activator. In some embodiments, a chiral reagent and an activator are delivered simultaneously. In some embodiments, co-delivery comprises delivering an amount of a chiral reagent in solution (e.g., a phosphoramidite solution) and an amount of activator in a solution (e.g., a CMPT solution) in a polar aprotic solvent such as a nitrile solvent (e.g., acetonitrile).

In some embodiments, the step of coupling provides a crude product composition in which the chiral phosphite product is present in a diastereomeric excess of >95%. In some embodiments, the chiral phosphite product is present in a diastereomeric excess of >96%. In some embodiments, the chiral phosphite product is present in a diastereomeric excess of >97%. In some embodiments, the chiral phosphite product is present in a diastereomeric excess of >98%. In some embodiments, the chiral phosphite product is present in a diastereomeric excess of >99%.

Capping Step:

Provided methods for making chirally controlled oligonucleotides comprise a step of capping. In some embodiments, a step of capping is a single step. In some embodiments, a step of capping is two steps. In some embodiments, a step of capping is more than two steps.

In some embodiments, a step of capping comprises steps of capping the free amine of the chiral auxiliary and capping any residual unreacted 5' hydroxyl groups. In some embodiments, the free amine of the chiral auxiliary and the unreacted 5' hydroxyl groups are capped with the same capping group. In some embodiments, the free amine of the chiral auxiliary and the unreacted 5' hydroxyl groups are capped with different capping groups. In certain embodiments, capping with different capping groups allows for selective removal of one capping group over the other during synthesis of the oligonucleotide. In some embodiments, the capping of both groups occurs simultaneously. In some embodiments, the capping of both groups occurs iteratively.

In certain embodiments, capping occurs iteratively and comprises a first step of capping the free amine followed by a second step of capping the free 5' hydroxyl group, wherein both the free amine and the 5' hydroxyl group are capped with the same capping group. For instance, in some embodiments, the free amine of the chiral auxiliary is capped using an anhydride (e.g., phenoxyacetic anhydride, i.e., Pac$_2$O) prior to capping of the 5' hydroxyl group with the same anhydride. In certain embodiments, the capping of the 5' hydroxyl group with the same anhydride occurs under different conditions (e.g., in the presence of one or more additional reagents). In some embodiments, capping of the 5' hydroxyl group occurs in the presence of an amine base in an etherial solvent (e.g., NMI (N-methylimidazole) in THF). The phrase "capping group" is used interchangeably herein with the phrases "protecting group" and "blocking group".

In some embodiments, an amine capping group is characterized in that it effectively caps the amine such that it prevents rearrangement and/or decomposition of the intermediate phosphite species. In some embodiments, a capping group is selected for its ability to protect the amine of the chiral auxiliary in order to prevent intramolecular cleavage of the internucleotide linkage phosphorus.

In some embodiments, a 5' hydroxyl group capping group is characterized in that it effectively caps the hydroxyl group such that it prevents the occurrence of "shortmers," e.g., "n−m" (m and n are integers and m<n; n is the number of bases in the targeted oligonucleotide) impurities that occur from the reaction of an oligonucleotide chain that fails to react in a first cycle but then reacts in one or more subsequent cycles. The presence of such shortmers, especially "n−1", has a deleterious effect upon the purity of the crude oligonucleotide and makes final purification of the oligonucleotide tedious and generally low-yielding.

In some embodiments, a particular cap is selected based on its tendency to facilitate a particular type of reaction under particular conditions. For instance, in some embodiments, a capping group is selected for its ability to facilitate an E1 elimination reaction, which reaction cleaves the cap and/or auxiliary from the growing oligonucleotide. In some embodiments, a capping group is selected for its ability to facilitate an E2 elimination reaction, which reaction cleaves the cap and/or auxiliary from the growing oligonucleotide. In some embodiments, a capping group is selected for its ability to facilitate a β-elimination reaction, which reaction cleaves the cap and/or auxiliary from the growing oligonucleotide.

Modifying Step:

As used herein, the phrase "modifying step", "modification step" and "P-modification step" are used interchangeably and refer generally to any one or more steps used to install a modified internucleotidic linkage. In some embodiments, the modified internucleotidic linkage having the structure of formula I. A P-modification step of the present invention occurs during assembly of a provided oligonucleotide rather than after assembly of a provided oligonucleotide is complete. Thus, each nucleotide unit of a provided oligonucleotide can be individually modified at the linkage phosphorus during the cycle within which the nucleotide unit is installed.

In some embodiments, a suitable P-modification reagent is a sulfur electrophile, selenium electrophile, oxygen electrophile, boronating reagent, or an azide reagent.

For instance, in some embodiments, a selenium reagent is elemental selenium, a selenium salt, or a substituted diselenide. In some embodiments, an oxygen electrophile is elemental oxygen, peroxide, or a substituted peroxide. In some embodiments, a boronating reagent is a borane-amine (e.g., N,N-diisopropylethylamine (BH$_3$.DIPEA), borane-pyridine (BH$_3$.Py), borane-2-chloropyridine (BH$_3$.CPy), borane-aniline (BH$_3$.An)), a borane-ether reagent (e.g., borane-tetrahydrofuran (BH$_3$.THF)), a borane-dialkylsulfide reagent (e.g., BH$_3$.Me$_2$S), aniline-cyanoborane, or a triphenylphosphine-carboalkoxyborane. In some embodiments, an azide reagent is comprises an azide group capable of undergoing subsequent reduction to provide an amine group.

In some embodiments, a P-modification reagent is a sulfurization reagent as described herein. In some embodiments, a step of modifying comprises sulfurization of phosphorus to provide a phosphorothioate linkage or phosphorothioate triester linkage. In some embodiments, a step of modifying provides an oligonucleotide having an internucleotidic linkage of formula I.

In some embodiments, the present invention provides sulfurizing reagents, and methods of making, and use of the same.

In some embodiments, such sulfurizing reagents are thiosulfonate reagents. In some embodiments, a thiosulfonate reagent has a structure of formula S-I:

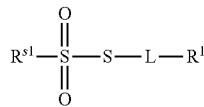

S-I wherein:

$R^{s1}$ is R; and each of R, L and $R^1$ is independently as defined and described above and herein.

In some embodiments, the sulfurizing reagent is a bis(thiosulfonate) reagent. In some embodiments, the bis(thiosulfonate) reagent has the structure of formula S-II:

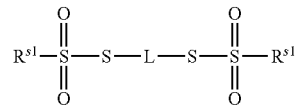

S-II wherein each of $R^{s1}$ and L is independently as defined and described above and herein.

As defined generally above, $R^{s1}$ is R, wherein R is as defined and described above and herein. In some embodiments, $R^{s1}$ is optionally substituted aliphatic, aryl, heterocyclyl or heteroaryl. In some embodiments, $R^{s1}$ is optionally substituted alkyl. In some embodiments, $R^{s1}$ is optionally substituted alkyl. In some embodiments, $R^{s1}$ is methyl. In some embodiments, $R^{s1}$ is cyanomethyl. In some embodiments, $R^{s1}$ is nitromethyl. In some embodiments, $R^{s1}$ is optionally substituted aryl. In some embodiments, $R^{s1}$ is optionally substituted phenyl. In some embodiments, $R^{s1}$ is phenyl. In some embodiments, $R^{s1}$ is p-nitrophenyl. In some embodiments, $R^{s1}$ is p-methylphenyl. In some embodiments, $R^{s1}$ is p-chlorophenyl. In some embodiments, $R^{s1}$ is o-chlorophenyl. In some embodiments, $R^{s1}$ is 2,4,6-trichlorophenyl. In some embodiments, $R^{s1}$ is pentafluorophenyl. In some embodiments, $R^{s1}$ is optionally substituted heterocyclyl. In some embodiments, $R^{s1}$ is optionally substituted heteroaryl.

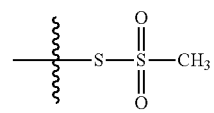 [SMILES: *SS(C)(=O)=O]

In some embodiments, $R^{s1}$—S(O)$_2$S— is O (MTS). In some embodiments, $R^{s1}$—S(O)$_2$S— is

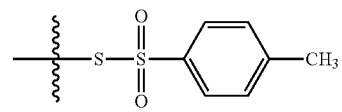 [SMILES: *SS(=O)(=O)c1ccc(C)cc1]

(TTS). In some embodiments, $R^{s1}$—S(O)$_2$S— is

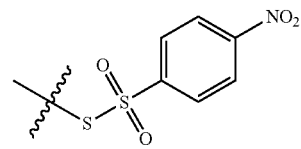 [SMILES: *SS(=O)(=O)c1ccc([N+](=O)[O-])cc1]

(NO$_2$PheTS). In some embodiments, $R^{s1}$—S(O)$_2$S— is

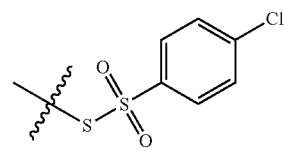 [SMILES: *SS(=O)(=O)c1ccc(Cl)cc1]

(p-ClPheTS). In some embodiments, $R^{s1}$—$S(O)_2S$— is

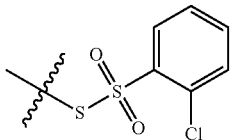 [SMILES: *SS(=O)(=O)c1ccccc1Cl]

(o-ClPheTS). In some embodiments, $R^{s1}$—$S(O)_2S$— is

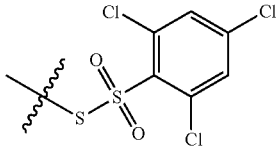 [SMILES: *SS(=O)(=O)c1c(Cl)cc(Cl)cc1Cl]

(2,4,6-TriClPheTS). In some embodiments, $R^{s1}$—$S(O)_2S$— is

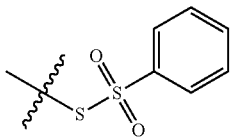 [SMILES: *SS(=O)(=O)c1ccccc1]

(PheTS). In some embodiments, $R^{s1}$—$S(O)_2S$— is

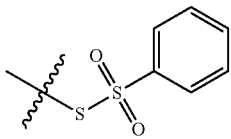 [SMILES: *SS(=O)(=O)c1ccccc1]

(PFPheTS). In some embodiments, $R^{s1}$—$S(O)_2S$— is

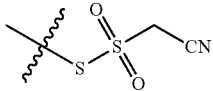 [SMILES: *SS(=O)(=O)CC#N]

(a-CNMTS). In some embodiments, $R^{s1}$—$S(O)_2S$— is

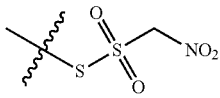

(a-NO$_2$MTS). In some embodiments, $R^{s1}$—$S(O)_2S$— is

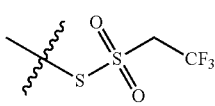 [SMILES: *SS(=O)(=O)CC(F)(F)F]

(a-CF$_3$MTS). In some embodiments, $R^{s1}$—$S(O)_2S$— is

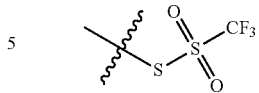

(a-CF$_3$TS). In some embodiments, $R^{s1}$—$S(O)_2S$— is

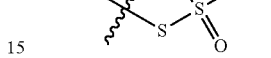

(a-CHF$_2$TS). In some embodiments, $R^{s1}$—$S(O)_2S$— is

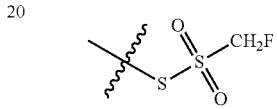

(a-CH$_2$FTS).

In some embodiments, the sulfurizing reagent has the structure of S-I or S-II, wherein L is —S—$R^{L3}$— or —S—C(O)—$R^{L3}$—. In some embodiments, L is —S—$R^{L3}$— or —S—C(O)—$R^{L3}$— wherein $R^{L3}$ is an optionally substituted $C_1$-$C_6$ alkylene. In some embodiments, L is —S—$R^{L3}$— or —S—C(O)—$R^{L3}$—, wherein $R^{L3}$ is an optionally substituted $C_1$-$C_6$ alkenylene. In some embodiments, L is —S—$R^{L3}$— or —S—C(O)—$R^{L3}$—, wherein $R^{L3}$ is an optionally substituted $C_1$-$C_6$ alkylene wherein one or more methylene units are optionally and independently replaced by an optionally substituted $C_1$-$C_6$ alkenylene, arylene, or heteroarylene. In some embodiments, $R^{L3}$ is an optionally substituted —S—($C_1$-$C_6$ alkenylene)-, —S—($C_1$-$C_6$ alkylene)-, —S—($C_1$-$C_6$ alkylene)-arylene-($C_1$-$C_6$ alkylene)-, —S—CO-arylene-($C_1$-$C_6$ alkylene)-, or —S—CO—($C_1$-$C_6$ alkylene)-arylene-($C_1$-$C_6$ alkylene)-. In some embodiments, the sulfurizing reagent has the structure of S-I or S-II, wherein L is —S—$R^{L3}$— or —S—C(O)—$R^{L3}$—, and the sulfur atom is connected to $R^1$.

In some embodiments, the sulfurizing reagent has the structure of S-I or S-II, wherein L is alkylene, alkenylene, arylene or heteroarylene.

In some embodiments, the sulfurizing reagent has the structure of S-I or S-II, wherein L is

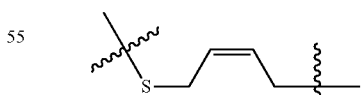

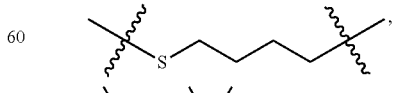

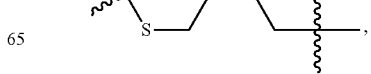

-continued
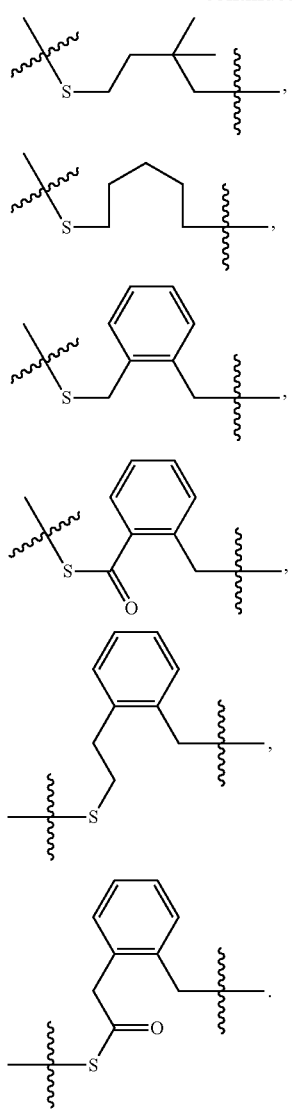
In some embodiments, L is
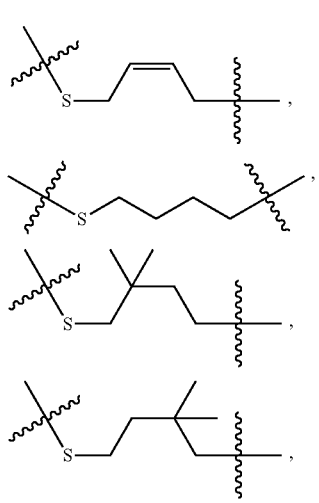
-continued
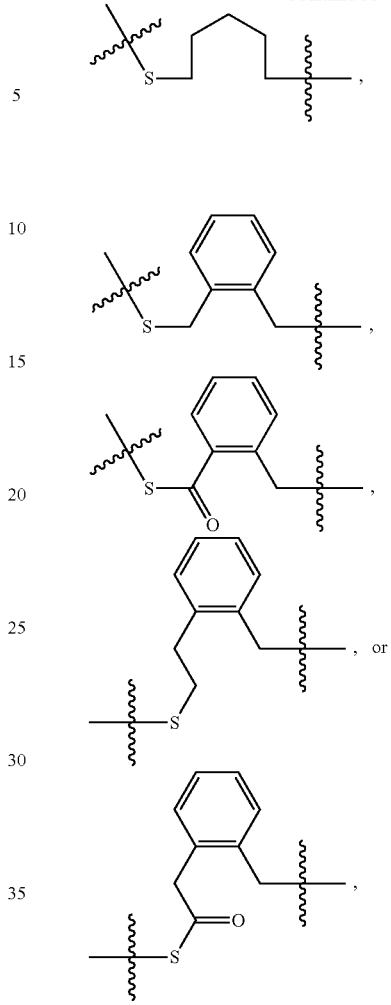
wherein the sulfur atom is connected to $R^1$.
In some embodiments, the sulfurizing reagent has the structure of S-I or S-II, wherein $R^1$ is
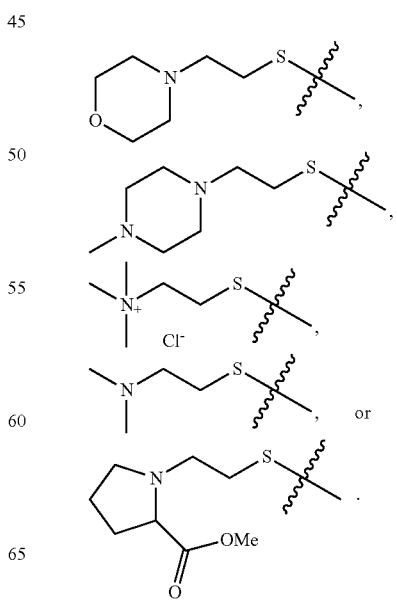

In some embodiments, $R^1$ is

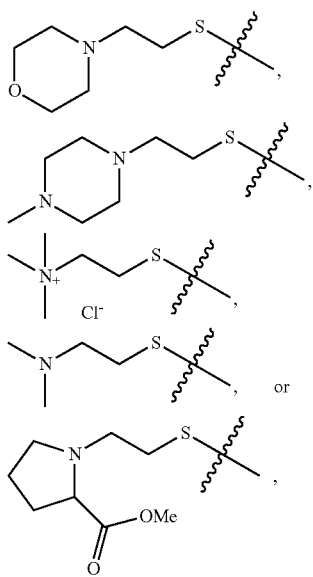

wherein the sulfur atom is connected to L.

In some embodiments, the sulfurizing reagent has the structure of S-I or S-II, wherein L is

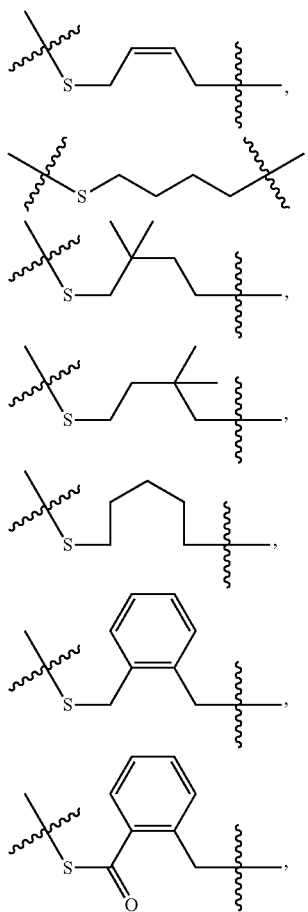

wherein the sulfur atom is connected to $R^1$; and $R^1$ is

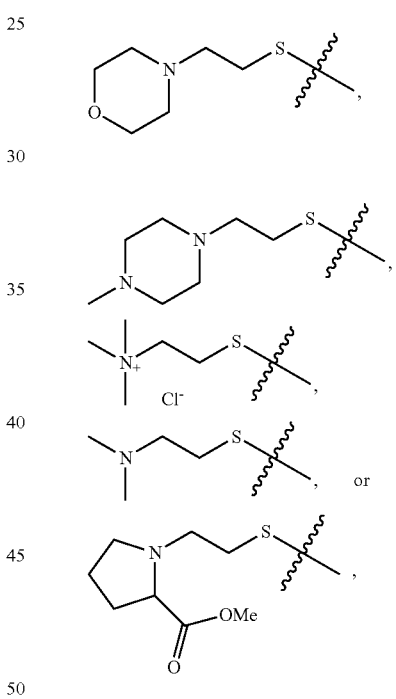

wherein the sulfur atom is connected to L.

In some embodiments, the sulfurizing reagent has the structure of S-I or S-II, wherein $R^1$ is —S—$R^{L2}$, wherein $R^{L2}$ is as defined and described above and herein. In some embodiments, $R^{L2}$ is an optionally substituted group selected from —S—($C_1$-$C_6$ alkylene)-heterocyclyl, —S—($C_1$-$C_6$ alkenylene)-heterocyclyl, —S—($C_1$-$C_6$ alkylene)-N(R')$_2$, —S—($C_1$-$C_6$ alkylene)-N(R')$_3$, wherein each R' is as defined above and described herein.

In some embodiments, -L-$R^1$ is —$R^{L3}$—S—S—$R^{L2}$, wherein each variable is independently as defined above and described herein. In some embodiments, -L-$R^1$ is —$R^{L3}$—C(O)—S—S—$R^{L2}$, wherein each variable is independently as defined above and described herein.

Exemplary bis(thiosulfonate) reagents of formula S-II are depicted below:

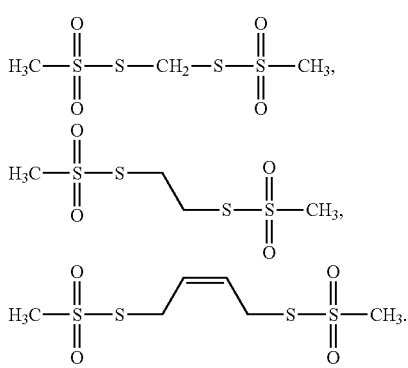

In some embodiments, the sulfurization reagent is a compound having one of the following formulae:

$S_8$, $R^{s2}$—S—S—$R^{s3}$, or $R^{s2}$—S—$X^s$—$R^{s3}$, wherein:
each of $R^{s2}$ and $R^{s3}$ is independently an optionally substituted group selected from aliphatic, aminoalkyl, carbocyclyl, heterocyclyl, heterocycloalkyl, aryl, heteroaryl, alkyloxy, aryloxy, heteroaryloxy, acyl, amide, imide, or thiocarbonyl; or
$R^{s2}$ and $R^{s3}$ are taken together with the atoms to which they are bound to form an optionally substituted heterocyclic or heteroaryl ring;
$X^s$ is —S(O)$_2$—, —O—, or —N(R')—; and
R' is as defined and described above and herein.

In some embodiments, the sulfurization reagent is $S_8$,

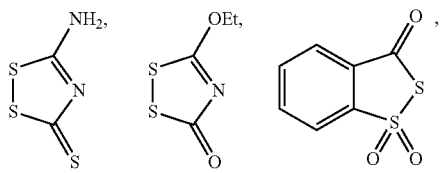

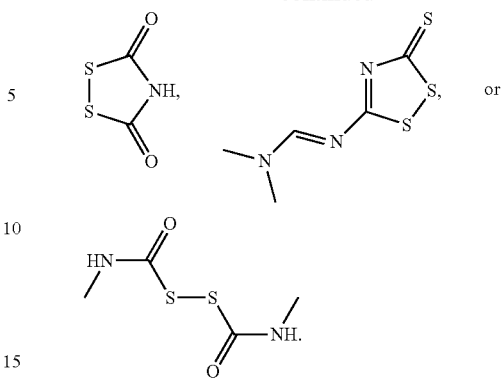

In some embodiments, the sulfurization reagent is $S_8$,

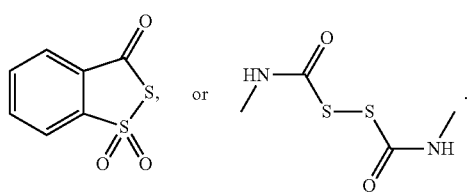

In some embodiments, the sulfurization reagent is

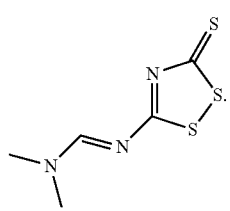

Exemplary sulfuring reagents are depicted in Table 5 below.

TABLE 5

Exemplary sulfurization reagents.

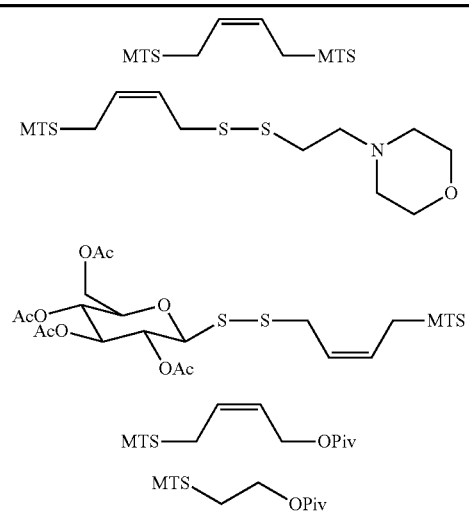

TABLE 5-continued
Exemplary sulfurization reagents.
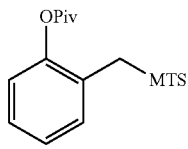
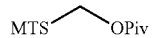
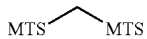
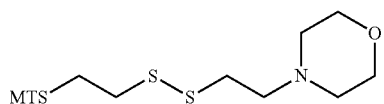
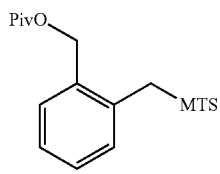
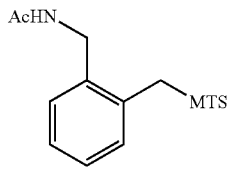
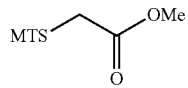
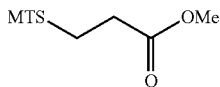
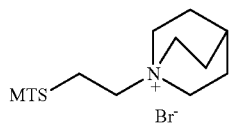
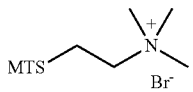
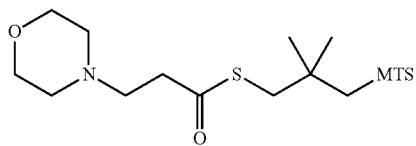
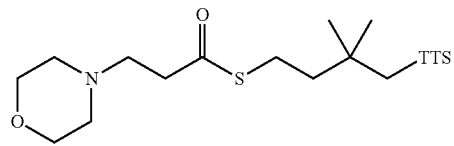

TABLE 5-continued
Exemplary sulfurization reagents.
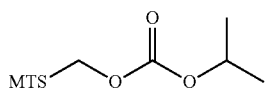
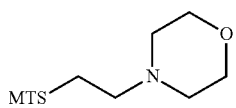
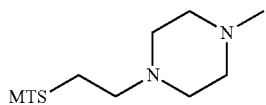
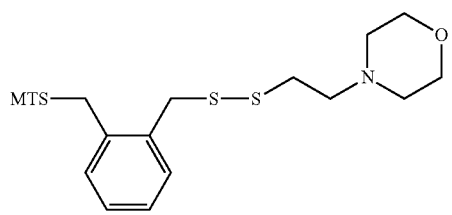
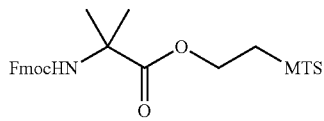
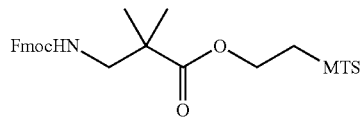
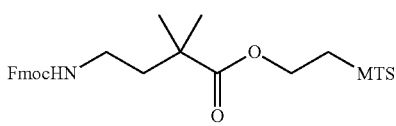
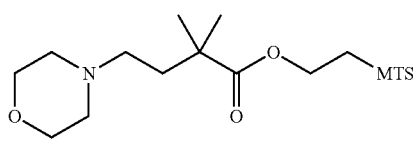
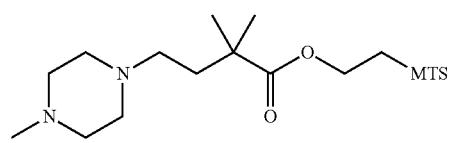
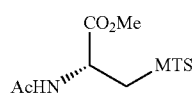
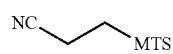
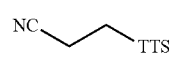
$S_8$ TABLE 5-continued
Exemplary sulfurization reagents.
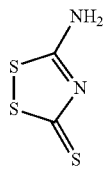
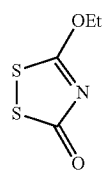
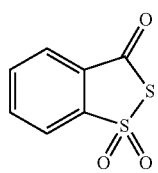 [SMILES: O=C1SS(=O)(=O)c2ccccc21]
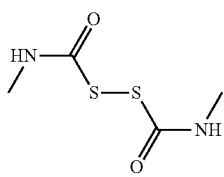
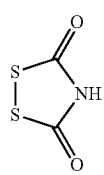
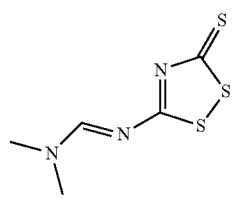
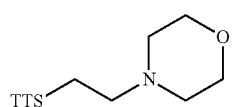
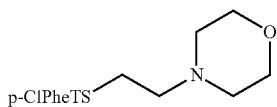
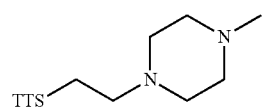
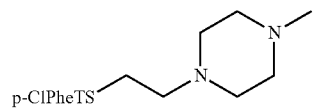

TABLE 5-continued

Exemplary sulfurization reagents.

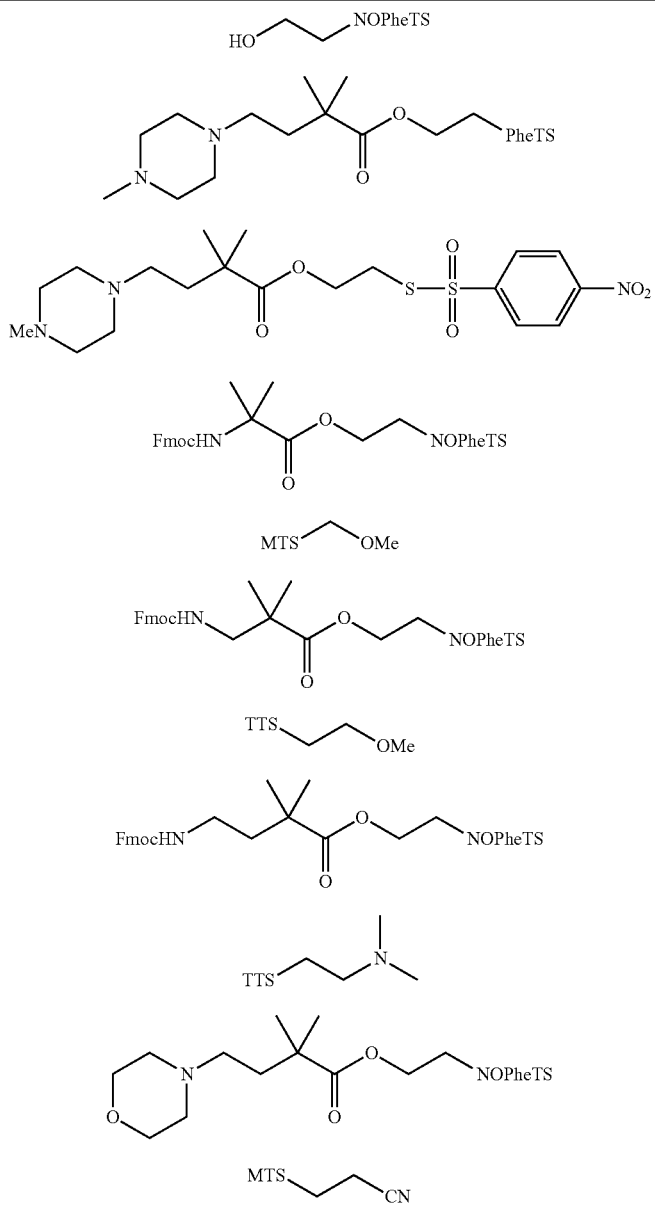

In some embodiments, a provided sulfurization reagent is used to modify an H-phosphonate. For instance, in some embodiments, an H-phosphonate oligonucleotide is synthesized using, e.g., a method of Wada I or Wada II, and is modified using a sulfurization reagent of formula S-I or S-II:

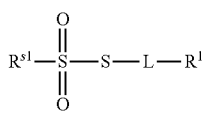

S-I

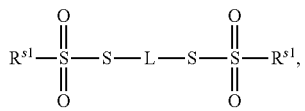

S-II wherein each of $R^{S1}$, L, and R' are as described and defined above and herein.

In some embodiments, the present invention provides a process for synthesizing a phosphorothioate triester, comprising steps of:

i) reacting an H-phosphonate of structure:

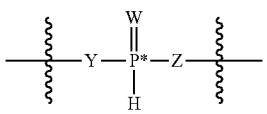

wherein each of W, Y, and Z are as described and defined above and herein, with a silylating reagent to provide a silyloxyphosphonate; and ii) reacting the silyloxyphosphonate with a sulfurization reagent of structure S-I or S-II:

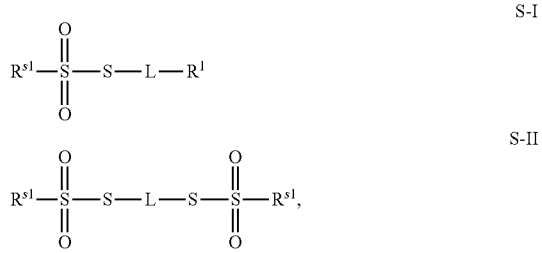

to provide a phosphorothiotriester.

In some embodiments, a selenium electrophile is used instead of a sulfurizing reagent to introduce modification to the internucleotidic linkage. In some embodiments, a selenium electrophile is a compound having one of the following formulae:

$$\text{Se, } R^{s2}\text{—Se—Se—}R^{s3}, \text{ or } R^{s2}\text{—Se—}X^{s}\text{—}R^{s3},$$

wherein:

each of $R^{s2}$ and $R^{s3}$ is independently an optionally substituted group selected from aliphatic, aminoalkyl, carbocyclyl, heterocyclyl, heterocycloalkyl, aryl, heteroaryl, alkyloxy, aryloxy, heteroaryloxy, acyl, amide, imide, or thiocarbonyl; or $R^{s2}$ and $R^{s3}$ are taken together with the atoms to which they are bound to form an optionally substituted heterocyclic or heteroaryl ring;

$X^s$ is —S(O)$_2$—, —O—, or —N(R')—; and

R' is as defined and described above and herein.

In other embodiments, the selenium electrophile is a compound of Se, KSeCN,

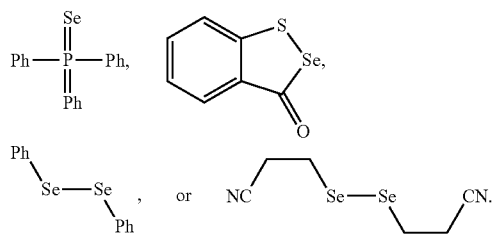

In some embodiments, the selenium electrophile is Se or

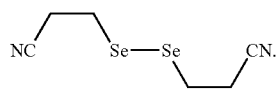

In some embodiments, a sulfurization reagent for use in accordance with the present invention is characterized in that the moiety transferred to phosphorus during sulfurization is a substituted sulfur (e.g., —SR) as opposed to a single sulfur atom (e.g., —S' or =S).

In some embodiments, a sulfurization reagent for use in accordance with the present invention is characterized in that the activity of the reagent is tunable by modifying the reagent with a certain electron withdrawing or donating group.

In some embodiments, a sulfurization reagent for use in accordance with the present invention is characterized in that it is crystalline. In some embodiments, a sulfurization reagent for use in accordance with the present invention is characterized in that it has a high degree of crystallinity. In certain embodiments, a sulfurization reagent for use in accordance with the present invention is characterized by ease of purification of the reagent via, e.g., recrystallization. In certain embodiments, a sulfurization reagent for use in accordance with the present invention is characterized in that it is substantially free from sulfur-containing impurities. In some embodiments, sulfurization reagents which are substantially free from sulfur-containing impurities show increased efficiency.

In some embodiments, the provided chirally controlled oligonucleotide comprises one or more phosphate diester linkages. To synthesize such chirally controlled oligonucleotides, one or more modifying steps are optionally replaced with an oxidation step to install the corresponding phosphate diester linkages. In some embodiments, the oxidation step is performed in a fashion similar to ordinary oligonucleotide synthesis. In some embodiments, an oxidation step comprises the use of I$_2$. In some embodiments, an oxidation step comprises the use of I$_2$ and pyridine. In some embodiments, an oxidation step comprises the use of 0.02 M I$_2$ in a THF/pyridine/water (70:20:10—v/v/v) co-solvent system. An exemplary cycle is depicted in Scheme I-c.

In some embodiments, a phosphorothioate precursor is used to synthesize chirally controlled oligonucleotides comprising phosphorothioate linkages. In some embodiments, such a phosphorothioate precursor is

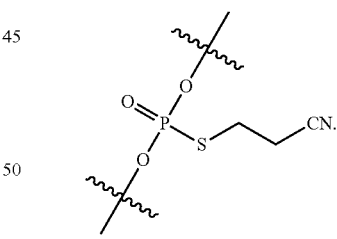

In some embodiments,

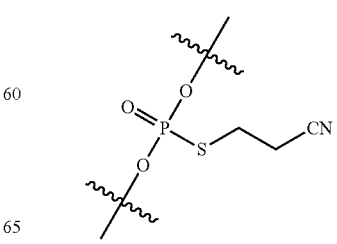

is converted into phosphorothioate diester linkages during standard deprotection/release procedure after cycle exit. Examples are further depicted below.

In some embodiments, the provided chirally controlled oligonucleotide comprises one or more phosphate diester linkages and one or more phosphorothioate diester linkages. In some embodiments, the provided chirally controlled oligonucleotide comprises one or more phosphate diester linkages and one or more phosphorothioate diester linkages, wherein at least one phosphate diester linkage is installed after all the phosphorothioate diester linkages when synthesized from 3' to 5'. To synthesize such chirally controlled oligonucleotides, in some embodiments, one or more modifying steps are optionally replaced with an oxidation step to install the corresponding phosphate diester linkages, and a phosphorothioate precursor is installed for each of the phosphorothioate diester linkages. In some embodiments, a phosphorothioate precursor is converted to a phosphorothioate diester linkage after the desired oligonucleotide length is achieved. In some embodiments, the deprotection/release step during or after cycle exit converts the phosphorothioate precursors into phosphorothioate diester linkages. In some embodiments, a phosphorothioate precursor is characterized in that it has the ability to be removed by a beta-elimination pathway. In some embodiments, a phosphorothioate precursor is

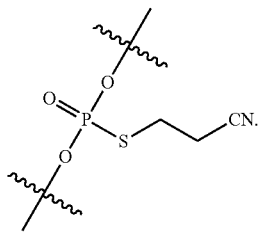

As understood by one of ordinary skill in the art, one of the benefits of using a phosphorothioate precursor, for instance,

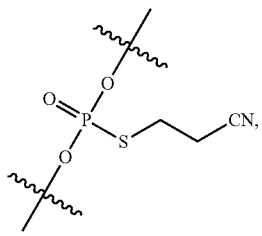

during synthesis is that

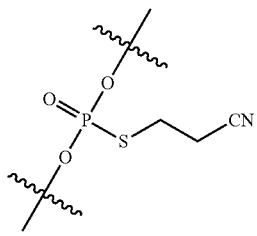

is more stable than phosphorothioate in certain conditions.

In some embodiments, a phosphorothioate precursor is a phosphorus protecting group as described herein, e.g., 2-cyanoethyl (CE or Cne), 2-trimethylsilylethyl, 2-nitroethyl, 2-sulfonylethyl, methyl, benzyl, o-nitrobenzyl, 2-(p-nitrophenyl)ethyl (NPE or Npe), 2-phenylethyl, 3-(N-tert-butylcarboxamido)-1-propyl, 4-oxopentyl, 4-methylthio-1-butyl, 2-cyano-1,1-dimethylethyl, 4-N-methylaminobutyl, 3-(2-pyridyl)-1-propyl, 2-[N-methyl-N-(2-pyridyl)]aminoethyl, 2-(N-formyl,N-methyl)aminoethyl, 4-[N-methyl-N-(2,2,2-trifluoroacetyl)amino]butyl. Examples are further depicted below.

Methods for synthesizing a desired sulfurization reagent are described herein and in the examples section.

As noted above, in some embodiments, sulfurization occurs under conditions which cleave the chiral reagent from the growing oligonucleotide. In some embodiments, sulfurization occurs under conditions which do not cleave the chiral reagent from the growing oligonucleotide.

In some embodiments, a sulfurization reagent is dissolved in a suitable solvent and delivered to the column. In certain embodiments, the solvent is a polar aprotic solvent such as a nitrile solvent. In some embodiments, the solvent is acetonitrile. In some embodiments, a solution of sulfurization reagent is prepared by mixing a sulfurization reagent (e.g., a thiosulfonate derivative as described herein) with BSTFA (N,O-bis-trimethylsilyl-trifluoroacetamide) in a nitrile solvent (e.g., acetonitrile). In some embodiments, BSTFA is not included. For example, the present inventors have found that relatively more reactive sulfurization reagents of general formula $R^{s2}$—S—$S(O)_2$—$R^{s3}$ can often successfully participate in sulfurization reactions in the absence of BSTFA. To give but one example, the inventors have demonstrated that where $R^{s2}$ is p-nitrophenyl and $R^{s3}$ is methyl then no BSTFA is required. In light of this disclosure, those skilled in the art will readily be able to determine other situations and/or sulfurization reagents that do not require BSTFA.

In some embodiments, the sulfurization step is performed at room temperature. In some embodiments, the sulfurization step is performed at lower temperatures such as about 0° C., about 5° C., about 10° C., or about 15° C. In some embodiments, the sulfurization step is performed at elevated temperatures of greater than about 20° C.

In some embodiments, a sulfurization reaction is run for about 1 minute to about 120 minutes. In some embodiments, a sulfurization reaction is run for about 1 minute to about 90 minutes. In some embodiments, a sulfurization reaction is run for about 1 minute to about 60 minutes. In some embodiments, a sulfurization reaction is run for about 1 minute to about 30 minutes. In some embodiments, a sulfurization reaction is run for about 1 minute to about 25 minutes. In some embodiments, a sulfurization reaction is run for about 1 minute to about 20 minutes. In some embodiments, a sulfurization reaction is run for about 1 minute to about 15 minutes. In some embodiments, a sulfurization reaction is run for about 1 minute to about 10 minutes. In some embodiments, a sulfurization reaction is run for about 5 minute to about 60 minutes.

In some embodiments, a sulfurization reaction is run for about 5 minutes. In some embodiments, a sulfurization reaction is run for about 10 minutes. In some embodiments, a sulfurization reaction is run for about 15 minutes. In some embodiments, a sulfurization reaction is run for about 20 minutes. In some embodiments, a sulfurization reaction is run for about 25 minutes. In some embodiments, a sulfurization reaction is run for about 30 minutes. In some embodiments, a sulfurization reaction is run for about 35 minutes. In some embodiments, a sulfurization reaction is run for about 40 minutes. In some embodiments, a sulfurization reaction is run for about 45 minutes. In some embodiments, a sulfurization reaction is run for about 50 minutes. In some embodiments, a sulfurization reaction is run for about 55 minutes. In some embodiments, a sulfurization reaction is run for about 60 minutes.

It was unexpectedly found that certain of the sulfurization modification products made in accordance with methods of the present invention are unexpectedly stable. In some embodiments, it the unexpectedly stable products are phosphorothioate triesters. In some embodiments, the unexpectedly stable products are chirally controlled oligonucleotides comprising one or more internucleotidic linkages having the structure of formula I-c.

One of skill in the relevant arts will recognize that sulfurization methods described herein and sulfurization reagents described herein are also useful in the context of modifying H-phosphonate oligonucleotides such as those described in Wada II (WO2010/064146).

In some embodiments, the sulfurization reaction has a stepwise sulfurization efficiency that is at least about 80%, 85%, 90%, 95%, 96%, 97%, or 98%. In some embodiments, the sulfurization reaction provides a crude dinucleotide product composition that is at least 98% pure. In some embodiments, the sulfurization reaction provides a crude tetranucleotide product composition that is at least 90% pure. In some embodiments, the sulfurization reaction provides a crude dodecanucleotide product composition that is at least 70% pure. In some embodiments, the sulfurization reaction provides a crude icosanucleotide product composition that is at least 50% pure.

Once the step of modifying the linkage phosphorus is complete, the oligonucleotide undergoes another deblock step in preparation for re-entering the cycle. In some embodiments, a chiral auxiliary remains intact after sulfurization and is deblocked during the subsequent deblock step, which necessarily occurs prior to re-entering the cycle. The process of deblocking, coupling, capping, and modifying, are repeated until the growing oligonucleotide reaches a desired length, at which point the oligonucleotide can either be immediately cleaved from the solid support or left attached to the support for purification purposes and later cleaved. In some embodiments, one or more protecting groups are present on one or more of the nucleotide bases, and cleavage of the oligonucleotide from the support and deprotection of the bases occurs in a single step. In some embodiments, one or more protecting groups are present on one or more of the nucleotide bases, and cleavage of the oligonucleotide from the support and deprotection of the bases occurs in more than one steps. In some embodiments, deprotection and cleavage from the support occurs under basic conditions using, e.g., one or more amine bases. In certain embodiments, the one or more amine bases comprise propyl amine. In certain embodiments, the one or more amine bases comprise pyridine.

In some embodiments, cleavage from the support and/or deprotection occurs at elevated temperatures of about 30° C. to about 90° C. In some embodiments, cleavage from the support and/or deprotection occurs at elevated temperatures of about 40° C. to about 80° C. In some embodiments, cleavage from the support and/or deprotection occurs at elevated temperatures of about 50° C. to about 70° C. In some embodiments, cleavage from the support and/or deprotection occurs at elevated temperatures of about 60° C. In some embodiments, cleavage from the support and/or deprotection occurs at ambient temperatures.

Exemplary purification procedures are described herein and/or are known generally in the relevant arts.

Noteworthy is that the removal of the chiral auxiliary from the growing oligonucleotide during each cycle is beneficial for at least the reasons that (1) the auxiliary will not have to be removed in a separate step at the end of the oligonucleotide synthesis when potentially sensitive functional groups are installed on phosphorus; and (2) unstable phosphorus-auxiliary intermediates prone to undergoing side reactions and/or interfering with subsequent chemistry are avoided. Thus, removal of the chiral auxiliary during each cycle makes the overall synthesis more efficient.

While the step of deblocking in the context of the cycle is described above, additional general methods are included below.

Deblocking Step

In some embodiments, the step of coupling is preceded by a step of deblocking. For instance, in some embodiments, the 5' hydroxyl group of the growing oligonucleotide is blocked (i.e., protected) and must be deblocked in order to subsequently react with a nucleoside coupling partner.

In some embodiments, acidification is used to remove a blocking group. In some embodiments, the acid is a Brønsted acid or Lewis acid. Useful Brønsted acids are carboxylic acids, alkylsulfonic acids, arylsulfonic acids, phosphoric acid and its derivatives, phosphonic acid and its derivatives, alkylphosphonic acids and their derivatives, arylphosphonic acids and their derivatives, phosphinic acid, dialkylphosphinic acids, and diarylphosphinic acids which have a pKa (25° C. in water) value of −0.6 (trifluoroacetic acid) to 4.76 (acetic acid) in an organic solvent or water (in the case of 80% acetic acid). The concentration of the acid (1 to 80%) used in the acidification step depends on the acidity of the acid. Consideration to the acid strength must be taken into account as strong acid conditions will result in depurination/depyrimidination, wherein purinyl or pyrimidinyl bases are cleaved from ribose ring and or other sugar ring. In some embodiments, an acid is selected from $R^{a1}COOH$, $R^{a1}SO_3H$, $R^{a3}SO_3H$,

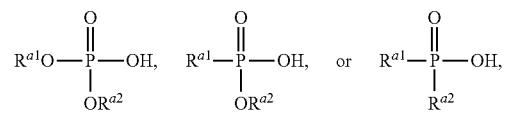

wherein each of $R^{a1}$ and $R^{a2}$ is independently hydrogen or an optionally substituted alkyl or aryl, and $R^{a3}$ is an optionally substituted alkyl or aryl.

In some embodiments, acidification is accomplished by a Lewis acid in an organic solvent. Exemplary such useful Lewis acids are $Zn(X^a)_2$ wherein $X^a$ is Cl, Br, I, or $CF_3SO_3$.

In some embodiments, the step of acidifying comprises adding an amount of a Brønsted or Lewis acid effective to remove a blocking group without removing purine moieties from the condensed intermediate.

Acids that are useful in the acidifying step also include, but are not limited to 10% phosphoric acid in an organic solvent, 10% hydrochloric acid in an organic solvent, 1% trifluoroacetic acid in an organic solvent, 3% dichloroacetic acid or trichloroacetic acid in an organic solvent or 80% acetic acid in water. The concentration of any Brønsted or Lewis acid used in this step is selected such that the concentration of the acid does not exceed a concentration that causes cleavage of a nucleobase from a sugar moiety.

In some embodiments, acidification comprises adding 1% trifluoroacetic acid in an organic solvent. In some embodiments, acidification comprises adding about 0.1% to about 8% trifluoroacetic acid in an organic solvent. In some embodiments, acidification comprises adding 3% dichloroacetic acid or trichloroacetic acid in an organic solvent. In some embodiments, acidification comprises adding about 0.1% to about 10% dichloroacetic acid or trichloroacetic acid in an organic solvent. In some embodiments, acidification comprises adding 3% trichloroacetic acid in an organic solvent. In some embodiments, acidification comprises adding about 0.1% to about 10% trichloroacetic acid in an organic solvent. In some embodiments, acidification comprises adding 80% acetic acid in water. In some embodiments, acidification comprises adding about 50% to about 90%, or about 50% to about 80%, about 50% to about 70%, about 50% to about 60%, about 70% to about 90% acetic acid in water. In some embodiments, the acidification comprises the further addition of cation scavengers to an acidic solvent. In certain embodiments, the cation scavengers can be triethylsilane or triisopropylsilane. In some embodiments, a blocking group is deblocked by acidification, which comprises adding 1% trifluoroacetic acid in an organic solvent. In some embodiments, a blocking group is deblocked by acidification, which comprises adding 3% dichloroacetic acid in an organic solvent. In some embodiments, a blocking group is deblocked by acidification, which comprises adding 3% trichloroacetic acid in an organic solvent. In some embodiments, a blocking group is deblocked by acidification, which comprises adding 3% trichloroacetic acid in dichloromethane.

In certain embodiments, methods of the present invention are completed on a synthesizer and the step of deblocking the hydroxyl group of the growing oligonucleotide comprises delivering an amount solvent to the synthesizer column, which column contains a solid support to which the oligonucleotide is attached. In some embodiments, the solvent is a halogenated solvent (e.g., dichloromethane). In certain embodiments, the solvent comprises an amount of an acid. In some embodiments, the solvent comprises an amount of an organic acid such as, for instance, trichloroacetic acid. In certain embodiments, the acid is present in an amount of about 1% to about 20% w/v. In certain embodiments, the acid is present in an amount of about 1% to about 10% w/v. In certain embodiments, the acid is present in an amount of about 1% to about 5% w/v. In certain embodiments, the acid is present in an amount of about 1 to about 3% w/v. In certain embodiments, the acid is present in an amount of about 3% w/v. Methods for deblocking a hydroxyl group are described further herein. In some embodiments, the acid is present in 3% w/v is dichloromethane.

In some embodiments, the chiral auxiliary is removed before the deblocking step. In some embodiments, the chiral auxiliary is removed during the deblocking step.

In some embodiments, cycle exit is performed before the deblocking step. In some embodiments, cycle exit is preformed after the deblocking step.

General Conditions for Blocking Group/Protecting Group Removal

Functional groups such as hydroxyl or amino moieties which are located on nucleobases or sugar moieties are routinely blocked with blocking (protecting) groups (moieties) during synthesis and subsequently deblocked. In general, a blocking group renders a chemical functionality of a molecule inert to specific reaction conditions and can later be removed from such functionality in a molecule without substantially damaging the remainder of the molecule (see e.g., Green and Wuts, Protective Groups in Organic Synthesis, 2nd Ed., John Wiley & Sons, New York, 1991). For example, amino groups can be blocked with nitrogen blocking groups such as phthalimido, 9-fludrenylmethoxycarbonyl (FMOC), triphenylmethylsulfenyl, t-BOC, 4,4'-dimethoxytrityl (DMTr), 4-methoxytrityl (MMTr), 9-phenylxanthin-9-yl (Pixyl), trityl (Tr), or 9-(p-methoxyphenyl)xanthin-9-yl (MOX). Carboxyl groups can be protected as acetyl groups. Hydroxy groups can be protected such as tetrahydropyranyl (THP), t-butyldimethylsilyl (TBDMS), 1-[(2-chloro-4-methyl)phenyl]-4-methoxypiperidin-4-yl (Ctmp), 1-(2-fluorophenyl)-4-methoxypiperidin-4-yl (Fpmp), 1-(2-chloroethoxy)ethyl, 3-methoxy-1,5-dicarbomethoxypentan-3-yl (MDP), bis(2-acetoxyethoxy)methyl (ACE), triisopropylsilyloxymethyl (TOM), 1-(2-cyanoethoxy)ethyl (CEE), 2-cyanoethoxymethyl (CEM), [4-(N-dichloroacetyl-N-methylamino)benzyloxy]methyl, 2-cyanoethyl (CN), pivaloyloxymethyl (PivOM), levunyloxymethyl (ALE). Other representative hydroxyl blocking groups have been described (see e.g., Beaucage et al., *Tetrahedron*, 1992, 46, 2223). In some embodiments, hydroxyl blocking groups are acid-labile groups, such as the trityl, monomethoxytrityl, dimethoxytrityl, trimethoxytrityl, 9-phenylxanthin-9-yl (Pixyl) and 9-(p-methoxyphenyl)xanthin-9-yl (MOX). Chemical functional groups can also be blocked by including them in a precursor form. Thus an azido group can be considered a blocked form of an amine as the azido group is easily converted to the amine. Further representative protecting groups utilized in nucleic acid synthesis are known (see e.g. Agrawal et al., Protocols for Oligonucleotide Conjugates, Eds., Humana Press, New Jersey, 1994, Vol. 26, pp. 1-72).

Various methods are known and used for removal of blocking groups from nucleic acids. In some embodiments, all blocking groups are removed. In some embodiments, a portion of blocking groups are removed. In some embodiments, reaction conditions can be adjusted to selectively remove certain blocking groups.

In some embodiments, nucleobase blocking groups, if present, are cleavable with an acidic reagent after the assembly of a provided oligonucleotide. In some embodiment, nucleobase blocking groups, if present, are cleavable under neither acidic nor basic conditions, e.g. cleavable with fluoride salts or hydrofluoric acid complexes. In some embodiments, nucleobase blocking groups, if present, are cleavable in the presence of base or a basic solvent after the assembly of a provided oligonucleotide. In certain embodiments, one or more of the nucleobase blocking groups are characterized in that they are cleavable in the presence of base or a basic solvent after the assembly of a provided oligonucleotide but are stable to the particular conditions of one or more earlier deprotection steps occurring during the assembly of the provided oligonucleotide.

In some embodiments, blocking groups for nucleobases are not required. In some embodiments, blocking groups for nucleobases are required. In some embodiments, certain nucleobases require one or more blocking groups while other nucleobases do not require one or more blocking groups.

In some embodiments, the oligonucleotide is cleaved from the solid support after synthesis. In some embodiments, cleavage from the solid support comprises the use of propylamine. In some embodiments, cleavage from the solid support comprises the use of propylamine in pyridine. In some embodiments, cleavage from the solid support comprises the use of 20% propylamine in pyridine. In some embodiments, cleavage from the solid support comprises the use of propylamine in anhydrous pyridine. In some embodiments, cleavage from the solid support comprises the use of 20% propylamine in anhydrous pyridine. In some embodiments, cleavage from the solid support comprises use of a polar aprotic solvent such as acetonitrile, NMP, DMSO, sulfone, and/or lutidine. In some embodiments, cleavage from the solid support comprises use of solvent, e.g., a polar aprotic solvent, and one or more primary amines (e.g., a $C_{1-10}$ amine), and/or one or more of methoxylamine, hydrazine, and pure anhydrous ammonia.

In some embodiments, deprotection of oligonucleotide comprises the use of propylamine. In some embodiments, deprotection of oligonucleotide comprises the use of propylamine in pyridine. In some embodiments, deprotection of oligonucleotide comprises the use of 20% propylamine in pyridine. In some embodiments deprotection of oligonucleotide comprises the use of propylamine in anhydrous pyridine. In some embodiments, deprotection of oligonucleotide comprises the use of 20% propylamine in anhydrous pyridine.

In some embodiments, the oligonucleotide is deprotected during cleavage.

In some embodiments, cleavage of oligonucleotide from solid support, or deprotection of oligonucleotide, is performed at about room temperature. In some embodiments, cleavage of oligonucleotide from solid support, or deprotection of oligonucleotide, is performed at elevated temperature. In some embodiments, cleavage of oligonucleotide from solid support, or deprotection of oligonucleotide, is performed at above about 30° C., 40° C., 50° C., 60° C., 70° C., 80° C. 90° C. or 100° C. In some embodiments, cleavage of oligonucleotide from solid support, or deprotection of oligonucleotide, is performed at about 30° C., 40° C., 50° C., 60° C., 70° C., 80° C. 90° C. or 100° C. In some embodiments, cleavage of oligonucleotide from solid support, or deprotection of oligonucleotide, is performed at about 40-80° C. In some embodiments, cleavage of oligonucleotide from solid support, or deprotection of oligonucleotide, is performed at about 50-70° C. In some embodiments, cleavage of oligonucleotide from solid support, or deprotection of oligonucleotide, is performed at about 60° C.

In some embodiments, cleavage of oligonucleotide from solid support, or deprotection of oligonucleotide, is performed for more than 0.1 hr, 1 hr, 2 hrs, 5 hrs, 10 hrs, 15 hrs, 20 hrs, 24 hrs, 30 hrs, or 40 hrs. In some embodiments, cleavage of oligonucleotide from solid support, or deprotection of oligonucleotide, is performed for about 0.1-5 hrs. In some embodiments, cleavage of oligonucleotide from solid support, or deprotection of oligonucleotide, is performed for about 3-10 hrs. In some embodiments, cleavage of oligonucleotide from solid support, or deprotection of oligonucleotide, is performed for about 5-15 hrs. In some embodiments, cleavage of oligonucleotide from solid support, or deprotection of oligonucleotide, is performed for about 10-20 hrs. In some embodiments, cleavage of oligonucleotide from solid support, or deprotection of oligonucleotide, is performed for about 15-25 hrs. In some embodiments, cleavage of oligonucleotide from solid support, or deprotection of oligonucleotide, is performed for about 20-40 hrs. In some embodiments, cleavage of oligonucleotide from solid support, or deprotection of oligonucleotide, is performed for about 2 hrs. In some embodiments, cleavage of oligonucleotide from solid support, or deprotection of oligonucleotide, is performed for about 5 hrs. In some embodiments, cleavage of oligonucleotide from solid support, or deprotection of oligonucleotide, is performed for about 10 hrs. In some embodiments, cleavage of oligonucleotide from solid support, or deprotection of oligonucleotide, is performed for about 15 hrs. In some embodiments, cleavage of oligonucleotide from solid support, or deprotection of oligonucleotide, is performed for about 18 hrs. In some embodiments, cleavage of oligonucleotide from solid support, or deprotection of oligonucleotide, is performed for about 24 hrs.

In some embodiments, cleavage of oligonucleotide from solid support, or deprotection of oligonucleotide, is performed at room temperature for more than 0.1 hr, 1 hr, 2 hrs, 5 hrs, 10 hrs, 15 hrs, 20 hrs, 24 hrs, 30 hrs, or 40 hrs. In some embodiments, cleavage of oligonucleotide from solid support, or deprotection of oligonucleotide, is performed at room temperature for about 5-48 hrs. In some embodiments, cleavage of oligonucleotide from solid support, or deprotection of oligonucleotide, is performed at room temperature for about 10-24 hrs. In some embodiments, cleavage of oligonucleotide from solid support, or deprotection of oligonucleotide, is performed at room temperature for about 18 hrs. In some embodiments, cleavage of oligonucleotide from solid support, or deprotection of oligonucleotide, is performed at elevated temperature for more than 0.1 hr, 1 hr, 2 hrs, 5 hrs, 10 hrs, 15 hrs, 20 hrs, 24 hrs, 30 hrs, or 40 hrs. In some embodiments, cleavage of oligonucleotide from solid support, or deprotection of oligonucleotide, is performed at elevated temperature for about 0.5-5 hrs. In some embodiments, cleavage of oligonucleotide from solid support, or deprotection of oligonucleotide, is performed at about 60° C. for about 0.5-5 hrs. In some embodiments, cleavage of oligonucleotide from solid support, or deprotection of oligonucleotide, is performed at about 60° C. for about 2 hrs.

In some embodiments, cleavage of oligonucleotide from solid support, or deprotection of oligonucleotide comprises the use of propylamine and is performed at room temperature or elevated temperature for more than 0.1 hr, 1 hr, 2 hrs, 5 hrs, 10 hrs, 15 hrs, 20 hrs, 24 hrs, 30 hrs, or 40 hrs. Exemplary conditions are 20% propylamine in pyridine at room temperature for about 18 hrs, and 20% propylamine in pyridine at 60° C. for about 18 hrs, In some embodiments, the present invention provides methods for making a chirally controlled oligonucleotide comprising steps of:
 (1) coupling;
 (2) capping;
 (3) modifying;
 (4) deblocking; and
 (5) repeating steps (1)-(4) until a desired length is achieved;
wherein the chirally controlled oligonucleotide comprises at least one phosphorothioate diester linkage or at least one internucleotidic linkage having the structure of formula I-c.

In some embodiments, the present invention provides methods for making a chirally controlled oligonucleotide comprising steps of:
 (1) coupling;
 (2) capping;
 (3) modifying;
 (4) deblocking; and
 (5) repeating steps (1)-(4) until a desired length is achieved;
wherein:
at least one cycle of (1) to (4) forms an phosphorothioate diester linkage.

In some embodiments, the present invention provides methods for making a chirally controlled oligonucleotide comprising steps of:
(1) coupling;
(2) capping;
(3) modifying;
(4) deblocking; and
(5) repeating steps (1)-(4) until a desired length is achieved;
wherein:
at least one cycle of (1) to (4) forms an internucleotidic linkage having the structure of formula I-c.

In some embodiments, the present invention provides methods for making a chirally controlled oligonucleotide comprising steps of:
(1) coupling;
(2) capping;
(3) modifying;
(4) deblocking; and
(5) repeating steps (1)-(4) until a desired length is achieved;
wherein:
the coupling step comprises the use of an activating group and

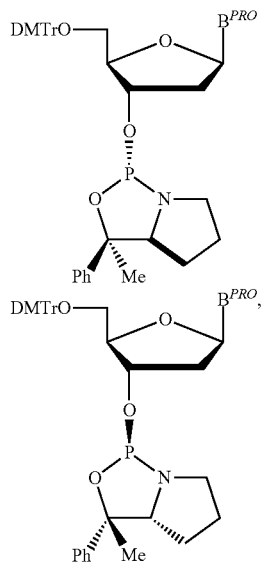

wherein $B^{PRO}$ is a protected nucleobase;
the capping step comprising capping of the amino group in the chiral auxiliary and the capping of unreacted 5'-OH;
the modifying step comprising installation of —S-L-R$^1$ group to the linkage phosphorus, wherein each of L and R$^1$ is independently as defined above and described herein;
the delocking step comprising the use of an acid.

In some embodiments, the present invention provides methods for making a chirally controlled oligonucleotide comprising steps of:
(1) coupling;
(2) capping;
(3) modifying;
(4) deblocking; and
(5) repeating steps (1)-(4) until a desired length is achieved;
wherein:
the coupling step comprises the use of CMPT and

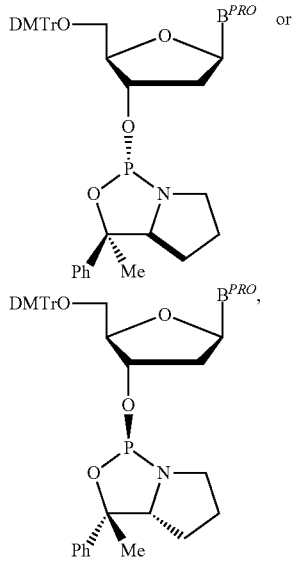

wherein $B^{PRO}$ is a protected nucleobase;
the capping step comprising capping of the amino group in the chiral auxiliary and the capping of unreacted 5'-OH;
the modifying step comprising installation of —S-L-R$^1$ group to the linkage phosphorus, wherein each of L and R$^1$ is independently as defined above and described herein;
the delocking step comprising the use of an acid.

In some embodiments, an activator is a "Wada" activator, i.e., the activator is from any one of Wada I, II, or III documents cited above.

Exemplary activating groups are depicted below:

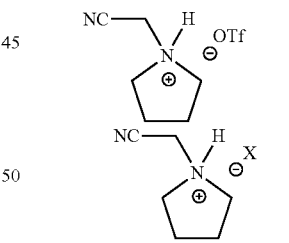

X = non nucleophilic anion

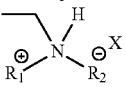

X = $^-$OTf, BF$_4^-$, PF6$^-$, TfN$^-$

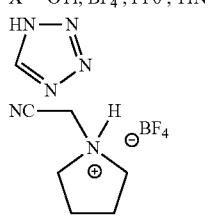

295
-continued
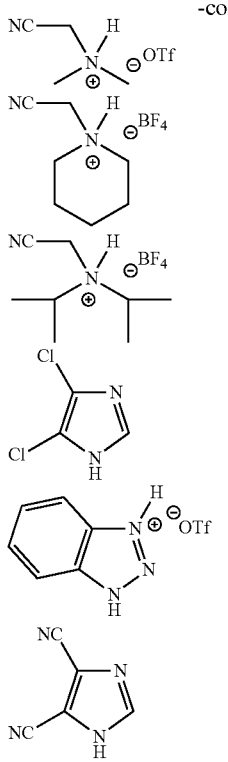
296
-continued
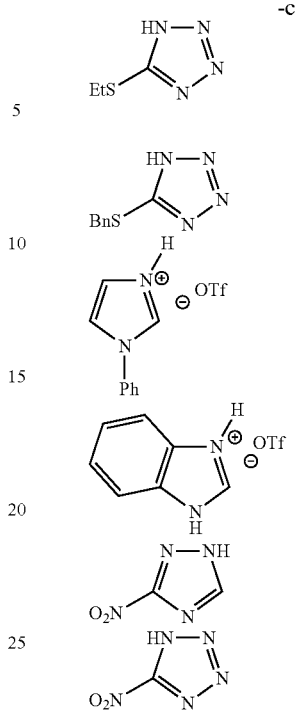
An exemplary cycle is depicted in Scheme I-b.
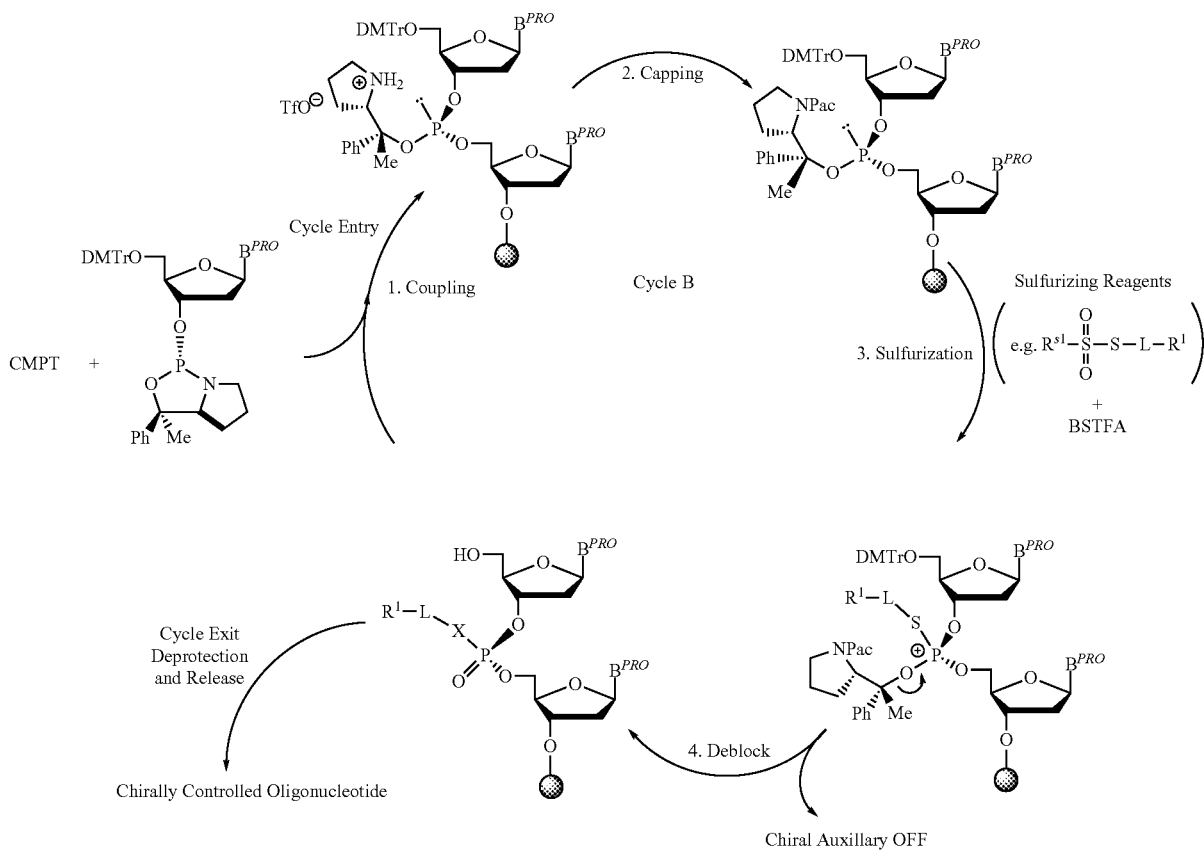

In some embodiments, the present invention provides methods for making a chirally controlled oligonucleotide comprising steps of:
(1) coupling;
(2) capping;
(3) modifying;
(4) deblocking; and
(5) repeating steps (1)-(4) until a desired length is achieved;
wherein:
the chirally controlled oligonucleotide comprises at least one phosphorothioate diester linkage or at least one internucleotidic linkage of formula I-c, and at least one phosphate diester internucleotidic linkage; and at least one modifying step is replaced by an oxidization step.

In some embodiments, the present invention provides methods for making a chirally controlled oligonucleotide comprising steps of:
(1) coupling;
(2) capping;
(3) modifying;
(4) deblocking; and
(5) repeating steps (1)-(4) until a desired length is achieved;
wherein:
the chirally controlled oligonucleotide comprises at least one phosphorothioate diester linkage or at least one internucleotidic linkage of formula I-c, and at least one phosphate diester internucleotidic linkage; and
at least one modifying step is replaced by an oxidization step comprising the use of $I_2$.

An exemplary cycle is illustrated in Scheme I-c.

Scheme I-c. Installation of both phosphate diester and modified internucleotidic linkages in a chirally controlled oligonucleotide.

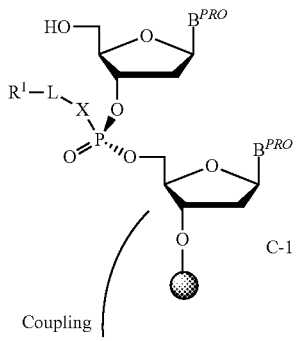

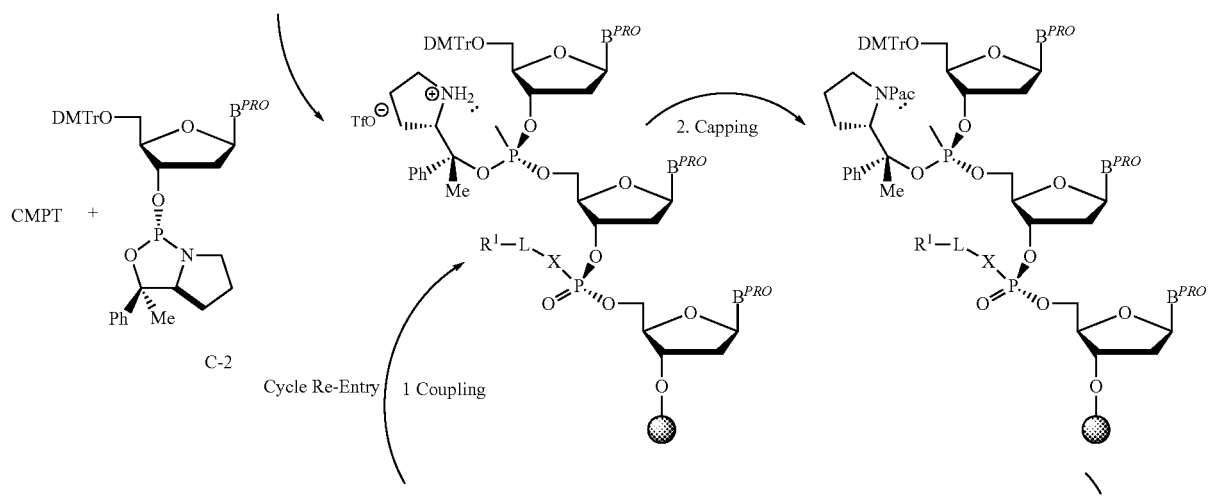

-continued

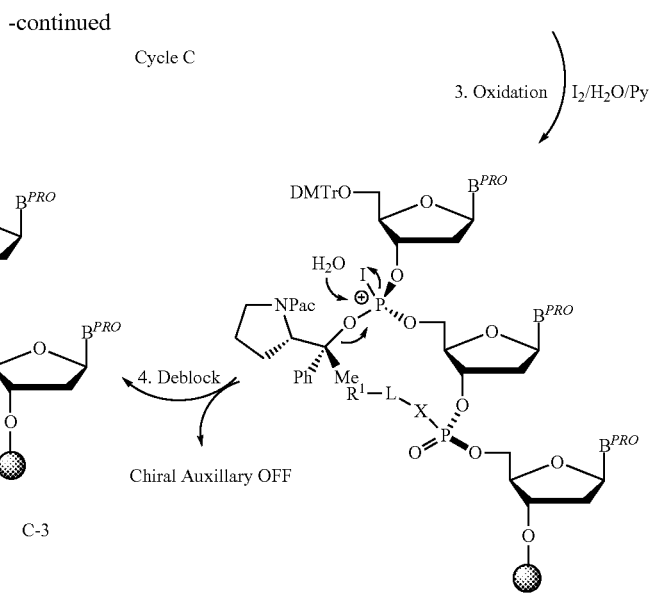

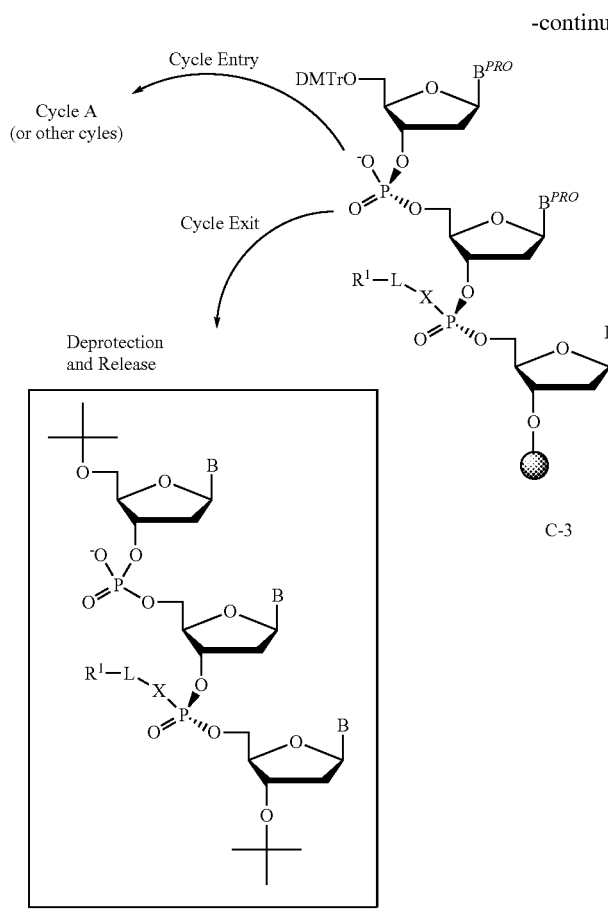

In Scheme I-c, oligonucleotide (or nucleotide, or oligonucleotide with modified internucleotidic linkage) on solid support (C-1) is coupled with phosphoramidite C-2. After coupling and capping, an oxidation step is performed. After deblocking, a phosphate diester linkage is formed. The cycle product C-3 can either re-enter cycle C to install more phosphate diester linkage, or enter other cycles to install other types of internucleotidic linkages, or go to cycle exit.

In some embodiments, non-chirally pure phosphoramidite can be used instead of C-2 in Scheme I-c. In some embodiments, β-cyanoethylphosphoramidites protected with DMTr is used. In some embodiments, the phosphoramidite being used has the structure of

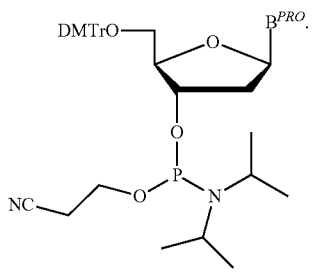

In some embodiments, the present invention provides methods for making a chirally controlled oligonucleotide comprising steps of:

(1) coupling;
(2) capping;
(3) modifying;
(4) deblocking; and
(5) repeating steps (1)-(4) until a desired length is achieved;
wherein:
the chirally controlled oligonucleotide comprises one or more phosphorothioate diester linkages; and
one or more phosphorothioate diester precursors are formed for each of the corresponding phosphorothioate diester linkage.

In some embodiments, the present invention provides methods for making a chirally controlled oligonucleotide comprising steps of:

(1) coupling;
(2) capping;
(3) modifying;
(4) deblocking; and
(5) repeating steps (1)-(4) until a desired length is achieved;
wherein:
the chirally controlled oligonucleotide comprises at least one phosphorothioate diester linkages; one or more phosphorothioate diester precursors are formed for each of the corresponding phosphorothioate diester linkage; and
each phosphorothioate diester precursor is converted to a phosphorothioate diester linkage after the desired length is achieved.

In some embodiments, the present invention provides methods for making a chirally controlled oligonucleotide comprising steps of:

(1) coupling;
(2) capping;
(3) modifying;
(4) deblocking; and
(5) repeating steps (1)-(4) until a desired length is achieved;
wherein:
the chirally controlled oligonucleotide comprises at least one phosphorothioate diester linkages and at least one phosphate diester internucleotidic linkage;
at least one modifying step is replaced by an oxidization step; and
at least one modifying step is performed to install a phosphorothioate diester precursor for each of the phosphorothioate diester linkages; and
each phosphorothioate diester precursor is converted to a phosphorothioate diester linkage after the desired length is achieved.

In some embodiments, the use of a phosphorothioate diester precursor increases the stability of oligonucleotide during synthesis. In some embodiments, the use of a phosphorothioate diester precursor improves the efficiency of chirally controlled oligonucleotide synthesis. In some embodiments, the use of a phosphorothioate diester precursor improves the yield of chirally controlled oligonucleotide synthesis. In some embodiments, the use of a phosphorothioate diester precursor improves the product purity of chirally controlled oligonucleotide synthesis.

In some embodiments, the phosphorothioate diester precursor in the above-mentioned methods is

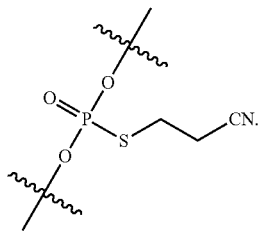

In some embodiments,

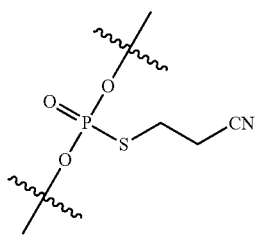

is converted to a phosphorothioate diester linkage during deprotection/release. An exemplary cycle is depicted in Scheme I-d. More examples are depicted below.

Scheme I-d. Phosphorothioate diester precursor in chirally controlled oligonucleotide synthesis.

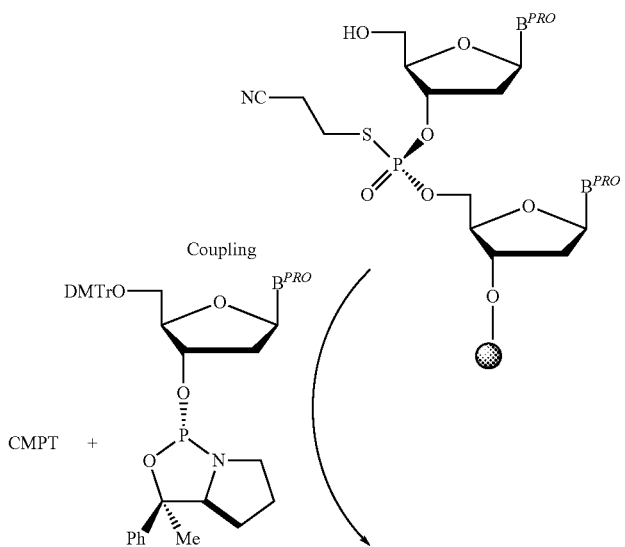

303
-continued
304
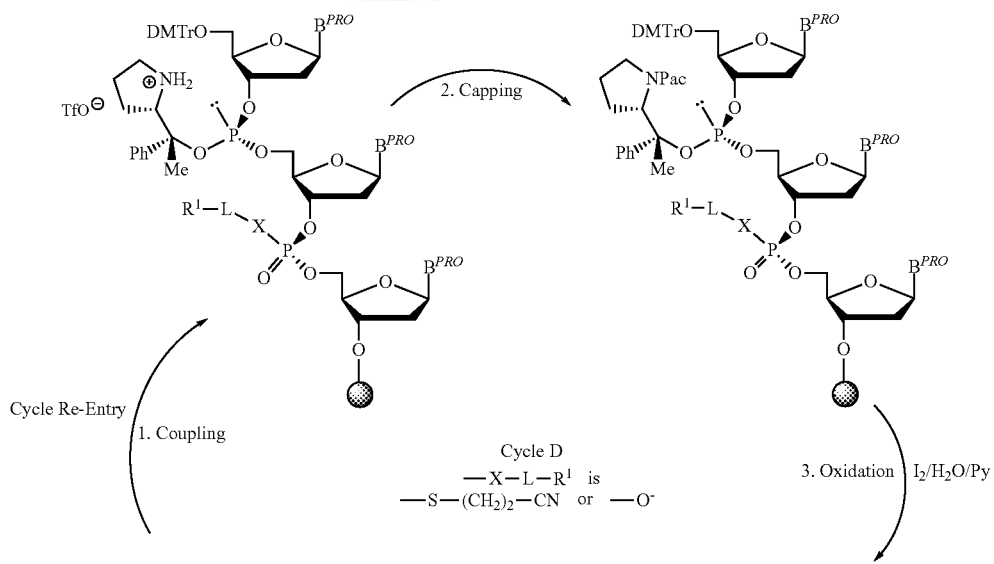
Cycle Re-Entry
1. Coupling
2. Capping
Cycle D
—X—L—R¹ is
—S—(CH₂)₂—CN or —O⁻
3. Oxidation I₂/H₂O/Py
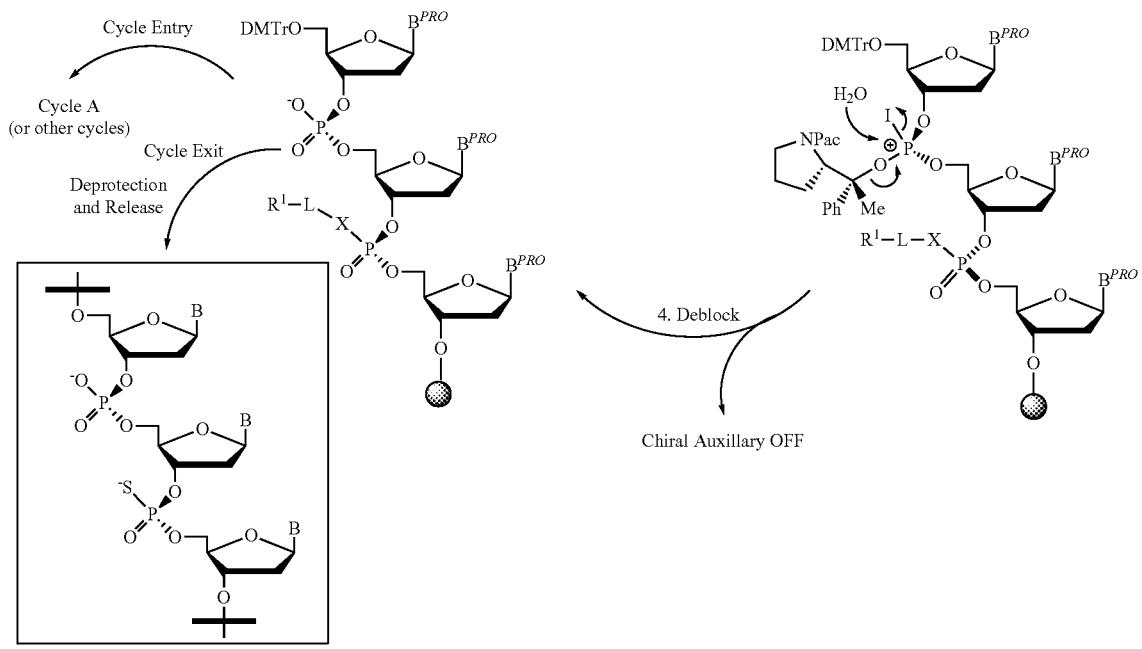
Cycle Entry
Cycle A (or other cycles)
Cycle Exit
Deprotection and Release
4. Deblock
Chiral Auxillary OFF As illustrated in Scheme I-d, both phosphorothioate and phosphate diester linkages can be incorporated into the same chirally controlled oligonucleotide. As understood by a person of ordinary skill in the art, the provided methods do not require that the phosphorothioate diester and the phosphate diester to be consecutive—other internucleotidic linkages can form between them using a cycle as described above. In Scheme I-d, phosphorothioate diester precursors,

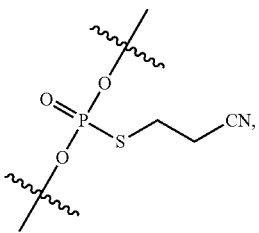

are installed in place of the phosphorothioate diester linkages. In some embodiments, such replacement provided increased synthesis efficiency during certain steps, for instance, the oxidation step. In some embodiments, the use of phosphorothioate diester precursors generally improve the stability of chirally controlled oligonucleotides during synthesis and/or storage. After cycle exit, during deprotection/release, the phosphorothioate diester precursor is converted to phosphorothioate diester linkage. In some embodiments, it is beneficial to use phosphorothioate diester precursor even when no phosphate diester linkage is present in the chirally controlled oligonucleotide, or no oxidation step is required during synthesis.

As in Scheme I-c, in some embodiments, non-chirally pure phosphoramidite can be used for cycles comprising oxidation steps. In some embodiments, β-cyanoethylphosphoramidites protected with DMTr is used. In some embodiments, the phosphoramidite being used has the structure of

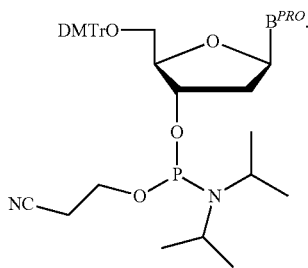

In some embodiments, methods of the present invention provide chirally controlled oligonucleotide compositions that are enriched in a particular oligonucleotide type.

In some embodiments, at least about 10% of a provided crude composition is of a particular oligonucleotide type. In some embodiments, at least about 20% of a provided crude composition is of a particular oligonucleotide type. In some embodiments, at least about 30% of a provided crude composition is of a particular oligonucleotide type. In some embodiments, at least about 40% of a provided crude composition is of a particular oligonucleotide type. In some embodiments, at least about 50% of a provided crude composition is of a particular oligonucleotide type. In some embodiments, at least about 60% of a provided crude composition is of a particular oligonucleotide type. In some embodiments, at least about 70% of a provided crude composition is of a particular oligonucleotide type. In some embodiments, at least about 80% of a provided crude composition is of a particular oligonucleotide type. In some embodiments, at least about 90% of a provided crude composition is of a particular oligonucleotide type. In some embodiments, at least about 95% of a provided crude composition is of a particular oligonucleotide type.

In some embodiments, at least about 1% of a provided composition is of a particular oligonucleotide type. In some embodiments, at least about 2% of a provided composition is of a particular oligonucleotide type. In some embodiments, at least about 3% of a provided composition is of a particular oligonucleotide type. In some embodiments, at least about 4% of a provided composition is of a particular oligonucleotide type. In some embodiments, at least about 5% of a provided composition is of a particular oligonucleotide type. In some embodiments, at least about 10% of a provided composition is of a particular oligonucleotide type. In some embodiments, at least about 20% of a provided composition is of a particular oligonucleotide type. In some embodiments, at least about 30% of a provided composition is of a particular oligonucleotide type. In some embodiments, at least about 40% of a provided composition is of a particular oligonucleotide type. In some embodiments, at least about 50% of a provided composition is of a particular oligonucleotide type. In some embodiments, at least about 60% of a provided composition is of a particular oligonucleotide type. In some embodiments, at least about 70% of a provided composition is of a particular oligonucleotide type. In some embodiments, at least about 80% of a provided composition is of a particular oligonucleotide type. In some embodiments, at least about 90% of a provided composition is of a particular oligonucleotide type. In some embodiments, at least about 95% of a provided composition is of a particular oligonucleotide type.

Biological Applications

As discussed in detail herein, the present invention provides, among other things, a chirally controlled oligonucleotide composition, meaning that the composition contains a plurality of oligonucleotides of at least one type. Each oligonucleotide molecule of a particular "type" is comprised of preselected (e.g., predetermined) structural elements with respect to: (1) base sequence; (2) pattern of backbone linkages; (3) pattern of backbone chiral centers; and (4) pattern of backbone P-modification moieties. In some embodiments, provided oligonucleotide compositions contain oligonucleotides that are prepared in a single synthesis process. In some embodiments, provided compositions contain oligonucleotides having more than one chiral configuration within a single oligonucleotide molecule (e.g., where different residues along the oligonucleotide have different stereochemistry); in some such embodiments, such oligonucleotides may be obtained in a single synthesis process, without the need for secondary conjugation steps to generate individual oligonucleotide molecules with more than one chiral configuration.

Oligonucleotide compositions as provided herein can be used as agents for modulating a number of cellular processes and machineries, including but not limited to, transcription, translation, immune responses, epigenetics, etc. In addition, oligonucleotide compositions as provided herein can be used as reagents for research and/or diagnostic purposes. One of ordinary skill in the art will readily recognize that the present invention disclosure herein is not limited to particular use but is applicable to any situations where the use of synthetic oligonucleotides is desirable. Among other things, provided compositions are useful in a variety of therapeutic, diagnostic, agricultural, and/or research applications.

In some embodiments, provided oligonucleotide compositions comprise oligonucleotides and/or residues thereof that include one or more structural modifications as described in detail herein. In some embodiments, provided oligonucleotide compositions comprise oligonucleoties that contain one or more nucleic acid analogs. In some embodiments, provided oligonucleotide compositions comprise oligonucleotides that contain one or more artificial nucleic acids or residues, including but not limited to: peptide nucleic acids (PNA), Morpholino and locked nucleic acids (LNA), glycon nucleic acids (GNA), threose nucleic acids (TNA), Xeno nucleic acids (ZNA), and any combination thereof.

In any of the embodiments, the invention is useful for oligonucleotide-based modulation of gene expression, immune response, etc. Accordingly, stereo-defined, oligonucleotide compositions of the invention, which contain oligonucleotides of predetermined type (i.e., which are chirally controlled, and optionally chirally pure), can be used in lieu of conventional stereo-random or chirally impure counterparts. In some embodiments, provided compositions show enhanced intended effects and/or reduced unwanted side effects. Certain embodiments of biological and clinical/therapeutic applications of the invention are discussed explicitly below.

Various dosing regimens can be utilized to administer provided chirally controlled oligonucleotide compositions. In some embodiments, multiple unit doses are administered, separated by periods of time. In some embodiments, a given composition has a recommended dosing regimen, which may involve one or more doses. In some embodiments, a dosing regimen comprises a plurality of doses each of which are separated from one another by a time period of the same length; in some embodiments, a dosing regimen comprises a plurality of doses and at least two different time periods separating individual doses. In some embodiments, all doses within a dosing regimen are of the same unit dose amount. In some embodiments, different doses within a dosing regimen are of different amounts. In some embodiments, a dosing regimen comprises a first dose in a first dose amount, followed by one or more additional doses in a second dose amount different from the first dose amount. In some embodiments, a dosing regimen comprises a first dose in a first dose amount, followed by one or more additional doses in a second (or subsequent) dose amount that is same as or different from the first dose (or another prior dose) amount. In some embodiments, a dosing regimen comprises administering at least one unit dose for at least one day. In some embodiments, a dosing regimen comprises administering more than one dose over a time period of at least one day, and sometimes more than one day. In some embodiments, a dosing regimen comprises administering multiple doses over a time period of at least week. In some embodiments, the time period is at least 2, 3, 4, 5, 6, 7, 8, 9, 10, 11, 12, 13, 14, 15, 16, 17, 18, 19, 20, 21, 22, 23 24, 25, 26, 27, 28, 29, 30, 31, 32, 33, 34, 35, 36, 37, 38, 39, 40 or more (e.g., about 45, 50, 55, 60, 65, 70, 75, 80, 85, 90, 95, 100 or more) weeks. In some embodiments, a dosing regimen comprises administering one dose per week for more than one week. In some embodiments, a dosing regimen comprises administering one dose per week for 2, 3, 4, 5, 6, 7, 8, 9, 10, 11, 12, 13, 14, 15, 16, 17, 18, 19, 20, 21, 22, 23 24, 25, 26, 27, 28, 29, 30, 31, 32, 33, 34, 35, 36, 37, 38, 39, 40 or more (e.g., about 45, 50, 55, 60, 65, 70, 75, 80, 85, 90, 95, 100 or more) weeks. In some embodiments, a dosing regimen comprises administering one dose every two weeks for more than two week period. In some embodiments, a dosing regimen comprises administering one dose every two weeks over a time period of 2, 3, 4, 5, 6, 7, 8, 9, 10, 11, 12, 13, 14, 15, 16, 17, 18, 19, 20, 21, 22, 23 24, 25, 26, 27, 28, 29, 30, 31, 32, 33, 34, 35, 36, 37, 38, 39, 40 or more (e.g., about 45, 50, 55, 60, 65, 70, 75, 80, 85, 90, 95, 100 or more) weeks. In some embodiments, a dosing regimen comprises administering one dose per month for one month. In some embodiments, a dosing regimen comprises administering one dose per month for more than one month. In some embodiments, a dosing regimen comprises administering one dose per month for 2, 3, 4, 5, 6, 7, 8, 9, 10, 11, 12, or more months. In some embodiments, a dosing regimen comprises administering one dose per week for about 10 weeks. In some embodiments, a dosing regimen comprises administering one dose per week for about 20 weeks. In some embodiments, a dosing regimen comprises administering one dose per week for about 30 weeks. In some embodiments, a dosing regimen comprises administering one dose per week for 26 weeks. In some embodiments, a chirally controlled oligonucleotide composition is administered according to a dosing regimen that differs from that utilized for a chirally uncontrolled (e.g., stereorandom) oligonucleotide composition of the same sequence, and/or of a different chirally controlled oligonucleotide composition of the same sequence. In some embodiments, a chirally controlled oligonucleotide composition is administered according to a dosing regimen that is reduced as compared with that of a chirally uncontrolled (e.g., sterorandom) oligonucleotide composition of the same sequence in that it achieves a lower level of total exposure over a given unit of time, involves one or more lower unit doses, and/or includes a smaller number of doses over a given unit of time. In some embodiments, a chirally controlled oligonucleotide composition is administered according to a dosing regimen that extends for a longer period of time than does that of a chirally uncontrolled (e.g., stereorandom) oligonucleotide composition of the same sequence Without wishing to be limited by theory, Applicant notes that in some embodiments, the shorter dosing regimen, and/or longer time periods between doses, may be due to the improved stability, bioavailability, and/or efficacy of a chirally controlled oligonucleotide composition. In some embodiments, a chirally controlled oligonucleotide composition has a longer dosing regimen compared to the corresponding chirally uncontrolled oligonucleotide composition. In some embodiments, a chirally controlled oligonucleotide composition has a shorter time period between at least two doses compared to the corresponding chirally uncontrolled oligonucleotide composition. Without wishing to be limited by theory, Applicant notes that in some embodiments longer dosing regimen, and/or shorter time periods between doses, may be due to the improved safety of a chirally controlled oligonucleotide composition.

A single dose can contain various amounts of a type of chirally controlled oligonucleotide, as desired suitable by the application. In some embodiments, a single dose contains about 1, 5, 10, 20, 30, 40, 50, 60, 70, 80, 90, 100, 110, 120, 130, 140, 150, 160, 170, 180, 190, 200, 210, 220, 230, 240, 250, 260, 270, 280, 290, 300 or more (e.g., about 350, 400, 450, 500, 550, 600, 650, 700, 750, 800, 850, 900, 950, 1000 or more) mg of a type of chirally controlled oligonucleotide. In some embodiments, a single dose contains about 1 mg of a type of chirally controlled oligonucleotide. In some embodiments, a single dose contains about 5 mg of a type of chirally controlled oligonucleotide. In some embodiments, a single dose contains about 10 mg of a type of chirally controlled oligonucleotide. In some embodiments, a single dose contains about 15 mg of a type of chirally controlled oligonucleotide. In some embodiments, a single dose contains about 20 mg of a type of chirally controlled oligonucleotide. In some embodiments, a single dose contains about 50 mg of a type of chirally controlled oligonucleotide. In some embodiments, a single dose contains about 100 mg of a type of chirally controlled oligonucleotide. In some embodiments, a single dose contains about 150 mg of a type of chirally controlled oligonucleotide. In some embodiments, a single dose contains about 200 mg of a type of chirally controlled oligonucleotide. In some embodiments, a single dose contains about 250 mg of a type of chirally controlled oligonucleotide. In some embodiments, a single dose contains about 300 mg of a type of chirally controlled oligonucleotide. In some embodiments, a chirally controlled oligonucleotide is administered at a lower amount in a single dose, and/or in total dose, than a chirally uncontrolled oligonucleotide. In some embodiments, a chirally controlled oligonucleotide is administered at a lower amount in a single dose, and/or in total dose, than a chirally uncontrolled oligonucleotide due to improved efficacy. In some embodiments, a chirally controlled oligonucleotide is administered at a higher amount in a single dose, and/or in total dose, than a chirally uncontrolled oligonucleotide. In some embodiments, a chirally controlled oligonucleotide is administered at a higher amount in a single dose, and/or in total dose, than a chirally uncontrolled oligonucleotide due to improved safety.

Biologically Active Oligonucleotides

A provided oligonucleotide composition as used herein may comprise single stranded and/or multiply stranded oligonucleotides. In some embodiments, single-stranded oligonucleotides contain self-complementary portions that may hybridize under relevant conditions so that, as used, even single-stranded oligonucleotides may have at least partially double-stranded character. In some embodiments, an oligonucleotide included in a provided composition is single-stranded, double-stranded, or triple-stranded. In some embodiments, an oligonucleotide included in a provided composition comprises a single-stranded portion and a multiple-stranded portion within the oligonucleotide. In some embodiments, as noted above, individual single-stranded oligonucleotides can have double-stranded regions and single-stranded regions.

In some embodiments, provided compositions include one or more oligonucleotides fully or partially complementary to strand of: structural genes, genes control and/or termination regions, and/or self-replicating systems such as viral or plasmid DNA. In some embodiments, provided compositions include one or more oligonucleotides that are or act as siRNAs or other RNA interference reagents (RNAi agents or iRNA agents), shRNA, antisense oligonucleotides, self-cleaving RNAs, ribozymes, fragment thereof and/or variants thereof (such as Peptidyl transferase 23S rRNA, RNase P, Group I and Group II introns, GIR1 branching ribozymes, Leadzyme, Hairpin ribozymes, Hammerhead ribozymes, HDV ribozymes, Mammalian CPEB3 ribozyme, VS ribozymes, glmS ribozymes, CoTC ribozyme, etc.), microRNAs, microRNA mimics, supermirs, aptamers, antimirs, antagomirs, U1 adaptors, triplex-forming oligonucleotides, RNA activators, long non-coding RNAs, short non-coding RNAs (e.g., piRNAs), immunomodulatory oligonucleotides (such as immunostimulatory oligonucleotides, immunoinhibitory oligonucleotides), GNA, LNA, ENA, PNA, TNA, morpholinos, G-quadruplex (RNA and DNA), antiviral oligonucleotides, and decoy oligonucleotides.

In some embodiments, provided compositions include one or more hybrid (e.g., chimeric) oligonucleotides. In the context of the present disclosure, the term "hybrid" broadly refers to mixed structural components of oligonucleotides. Hybrid oligonucleotides may refer to, for example, (1) an oligonucleotide molecule having mixed classes of nucleotides, e.g., part DNA and part RNA within the single molecule (e.g., DNA-RNA); (2) complementary pairs of nucleic acids of different classes, such that DNA:RNA base pairing occurs either intramolecularly or intermolecularly; or both; (3) an oligonucleotide with two or more kinds of the backbone or internucleotide linkages.

In some embodiments, provided compositions include one or more oligonucleotide that comprises more than one classes of nucleic acid residues within a single molecule. For example, in any of the embodiments described herein, an oligonucleotide may comprise a DNA portion and an RNA portion. In some embodiments, an oligonucleotide may comprise a unmodified portion and modified portion.

Provided oligonucleotide compositions can include oligonucleotides containing any of a variety of modifications, for example as described herein. In some embodiments, particular modifications are selected, for example, in light of intended use. In some embodiments, it is desirable to modify one or both strands of a double-stranded oligonucleotide (or a double-stranded portion of a single-stranded oligonucleotide). In some embodiments, the two strands (or portions) include different modifications. In some embodiments, the two strands include the same modifications. One of skill in the art will appreciate that the degree and type of modifications enabled by methods of the present invention allow for numerous permutations of modifications to be made. Exemplary such modifications are described herein and are not meant to be limiting.

RNA Interference

Provided oligonucleotide compositions are useful, among other things, for applications in RNA interference.

RNA interference (RNAi) refers to the inhibition of gene expression by RNA molecules. Typically, these are small, double-stranded RNA molecules. Since gene expression controls most cellular processes, the ability to inhibit gene expression provides a potentially powerful tool for modulating biological conditions, including treating human and/or animal (e.g., livestock or pet) diseases. A number of studies have been conducted to demonstrate the use of RNAi in regulating or controlling disease-associated gene expression. See, for example: Cullen, K. A., Hall, M. J. & Golosinskiy, A. Ambulatory surgery in the United States, 2006. Natl Health Stat Report 2009; 1-25; Elbashir S, Harborth J, Lendeckel W, Yalcin A, Weber K, Tuschl T. Duplexes of 21-nucleotide RNAs mediate RNA interference in cultured mammalian cells. Nature 2001; 411: 494-498; Fire A, Xu S, Montgomery M K, Kostas S A, Driveri S E & Mello C. Potent and specific RNA interference by double-stranded RNA in Caenorhadbditis elegans. Nature 1998; 391 (6669):806-811; Gauglitz, G. G., Kortin, H. C., Pavicic, T., Ruzicka, T., & Jeschke, M. G. Hypertrophic scarring and keloids: pathomechanisms and current emerging treatment strategies. MolMed 2011; 17(1-2): 113-125; Li-Tsang, C. W., Lau, J. C. & Chan, C. C. Prevalence of hypertrophic scar formation and its characteristics among the Chinese population. Burns 2005; 31, 610-616; Wang H, Ghosh A, Baigude H, Yang C, Qui L, Xia L, et al. Therapeutic gene silencing delivered by a chemically modified siRNA against mutant SOD1 slows ALS progression. *JBC* 2008; 283 (23):15845-15852; Weiser, T. G., Regenbogen, S. E., Thompson, K. D., Haynes, A. B., Lipsitz, S. R., Berry, W. R. & Gawande, A. A. An estimation of the global volume of surgery: a modeling strategy based on available data. *Lancet* 2008; 372 (9633):139-44.

The phenomenon of RNA interference was initially demonstrated in *C. elegans*, in which the injection of dsRNA molecules inhibited complementary gene expression. Though the use of siRNA has become a widely used tool for down-regulating gene expression, the existence of a naturally occurring pathway in eukaryotes has been well described. The origin of endogenous siRNA (or miRNA) may be transposons, viruses, repetitive sequences and genes. The process of producing effective endogenous siRNA is regulated by three enzymes. RNA-dependent RNA polymerases convert single-stranded RNA into double-stranded RNA. Alternatively, DNA-dependent RNA polymerases produce dsRNA by transcribing inverted DNA repeats. The resulting large RNA molecules are subject to digestion by ribonuclease III (Dicer) to produce short double-stranded siRNA molecules. Argonaute proteins are then required to bind siRNA molecules to form a complex known as RISC (RNA-induced silencing complex). RISC recognizes double-stranded RNA fragment and splits the double-strands apart, retaining one strand in the RISC complex. RISCs may then promote epigenetic silencing through RNA-directed DNA methylation or by target RNA cleavage. Though protein translation may be knocked down considerably, siRNA does not normally eliminate the expression of a gene target completely. RISC can therefore help the guide strand of RNA bind to and destroy its corresponding cellular messenger RNA target. Thus, RNAi provides a method to potentially block the creation of the proteins that cause disease.

siRNA technology represents a useful molecular tool. The use of RNA interference for artificially manipulating gene expression was initially limited by the activation of cellular antiviral mechanisms. Exposure of cells to sequences longer than 30 nucleotides has been shown to induce interferon gene expression resulting in non-specific RNA degradation and reduced protein synthesis. However, this problem can be circumvented by designing short (e.g., 19 to 22 nucleotide) siRNA sequences. Methods for siRNA delivery into cells include, without limitation, liposome-based addition of purified ribonucleotides to the media or transfection of plasmid vectors designed to express siRNA molecules. Plasmid vectors rely on the use of two RNA Polymerase III promoters (U6 and H1) to drive transcription of the siRNA molecule. The target sequence (19 to 29 nucleotides) is placed in a sense and antisense orientation with a small spacer group in between (short hairpin RNA or shRNA). Once transcribed, a hairpin structure is formed that can be recognized and cleaved by Dicer. Alternatively, RNA duplexes may be transcribed without hairpin structures and directly process by the RISC. Currently, there are a variety of plasmid and viral vectors that utilize similar concepts to produce siRNA, shRNA, or single stranded siRNA (ss-siRNA) molecules (See, e.g., 2012 Cell-150-883 Walt Lima et al. ssRNAi activate RNAi in animals).

In some embodiments, a provided oligonucleotide or oligonucleotide composition is useful as ss-siRNA or GalNAc conjugated siRNA.

The art is familiar with certain structural features that affect siRNA as a tool. Following the discovery of siRNA, several studies attempted to identify the optimal characteristics required for siRNA design. Some of the requirements include using sequences shorter than 30 nucleotides to avoid PKR activation, sequence stability at the 5' end of the antisense strand relative to the 3' terminus and inserting a TT overhang. Based on studies like these, a number of algorithms have been developed by academic and industrial labs to predict the most effective target sequences for a given gene. Though most of these programs are not perfect, the likelihood of obtaining a predicted sequence is superior to designing sequences without consideration of the recommended features. Synthesis and testing of multiple sequences may be required. The design of siRNA experiments may contain some potential pitfalls, thus the design should be done to include appropriate controls and measurable endpoints. A negative control may include a non-complementary sequence with thermodynamically similar properties as the effective siRNA sequence. When transfecting a plasmid vector to introduce siRNA or shRNA, the ratio of lipid to nucleic acid may be equal and the control vector may contain a sequence that is transcribed and processed intracellularly. Validation of the siRNA effect may also be carried out by measuring both RNA and protein expression.

In some embodiments, a provided oligonucleotide as used herein is double-stranded. Typically, double-stranded oligonucleotides comprising a duplex structure of between 20 and 23, but specifically 21, base pairs have been hailed as particularly effective in inducing RNA interference (Elbashir et al., EMBO 2001, 20:6877-6888). However, others have found that shorter or longer double-stranded oligonucleotides can be effective as well.

In some embodiments, a double-stranded oligonucleotide utilized in accordance with the present invention comprises two oligonucleotide strands that are sufficiently complementary to hybridize to form a duplex structure. In some embodiments, a duplex structure is between about 12 to about 45 base pairs in length. In some embodiments, a duplex structure is between about 18 to about 25 base pairs in length. In some embodiments, a duplex structure is between about 19 to about 24 base pairs in length. In some embodiments, a duplex structure is between about 19 to about 21 base pairs in length. In some embodiments, a duplex structure is a double-stranded oligonucleotides of between about 25 to about 30 base pairs in length. In some embodiments, a duplex structure is a double-stranded oligonucleotide of between about 10 to about 15 base pairs in length. In some embodiments, a double-stranded oligonucleotide is at least about 21 nucleotides long.

In some embodiments, a double-stranded oligonucleotide utilized in accordance with the present invention comprises a sense strand and an antisense strand, wherein the antisense RNA strand has a region of complementarity which is complementary to at least a part of a target sequence, and the duplex region is about 14 to about 30 nucleotides in length. In some embodiments, a region of complementarity to the target sequence is between about 14 to about 30 nucleotides in length. In some embodiments, a region of complementarity to the target sequence is between about 18 to about 25 nucleotides in length. In some embodiments, a region of complementarity to the target sequence is between about 19 to about 24 nucleotides in length. In some embodiments, a region of complementarity to the target sequence is about 19 to about 21 nucleotides in length.

The phrase "antisense strand" as used herein, refers to an oligonucleotide that is substantially or 100% complementary to a target sequence of interest. The phrase "antisense strand" includes the antisense region of both oligonucleotides that are formed from two separate strands, as well as unimolecular oligonucleotides that are capable of forming hairpin or dumbbell type structures. The terms "antisense strand" and "guide strand" are used interchangeably herein.

The phrase "sense strand" refers to an oligonucleotide that has the same nucleoside sequence, in whole or in part, as a target sequence such as a messenger RNA or a sequence of DNA. The terms "sense strand" and "passenger strand" are used interchangeably herein.

By "target sequence" is meant any nucleic acid sequence whose expression or activity is to be modulated. The target nucleic acid can be DNA or RNA, such as endogenous DNA or RNA, viral DNA or viral RNA, or other RNA encoded by a gene, virus, bacteria, fungus, mammal, or plant. In some embodiments, a target sequence is associated with a disease or disorder.

By "specifically hybridizable" and "complementary" is meant that a nucleic acid can form hydrogen bond(s) with another nucleic acid sequence by either traditional Watson-Crick or other non-traditional types. In reference to the nucleic molecules of the present invention, the binding free energy for a nucleic acid molecule with its complementary sequence is sufficient to allow the relevant function of the nucleic acid to proceed, e.g., RNAi activity. Determination of binding free energies for nucleic acid molecules is well known in the art (see, e.g., Turner et al, 1987, *CSH Symp. Quant. Biol.* LIT pp. 123-133; Frier et al., 1986, *Proc. Nat. Acad. Sci. USA* 83:9373-9377; Turner et al., 1987, *J. Ain. Chem. Soc.* 109:3783-3785)

A percent complementarity indicates the percentage of contiguous residues in a nucleic acid molecule that can form hydrogen bonds (e.g., Watson-Crick base pairing) with a second nucleic acid sequence (e.g., 5, 6, 7, 8, 9, 10 out of 10 being 50%, 60%, 70%, 80%, 90%, and 100% complementary). "Perfectly complementary" or 100% complementarity means that all the contiguous residues of a nucleic acid sequence will hydrogen bond with the same number of contiguous residues in a second nucleic acid sequence. Less than perfect complementarity refers to the situation in which some, but not all, nucleoside units of two strands can hydrogen bond with each other. "Substantial complementarity" refers to polynucleotide strands exhibiting 90% or greater complementarity, excluding regions of the polynucleotide strands, such as overhangs, that are selected so as to be noncomplementary. Specific binding requires a sufficient degree of complementarity to avoid non-specific binding of the oligomeric compound to non-target sequences under conditions in which specific binding is desired, e.g., under physiological conditions in the case of in vivo assays or therapeutic treatment, or in the case of in vitro assays, under conditions in which the assays are performed. In some embodiments, non-target sequences differ from corresponding target sequences by at least 5 nucleotides.

Double Stranded Oligonucleotides

In some embodiments, a double-stranded oligonucleotide utilized in accordance with the present invention is sufficiently large that it can be cleaved by an endogenous molecule, e.g., by Dicer, to produce smaller double-stranded oligonucleotides, e.g., RNAi agents. In some embodiments, a provided double-stranded oligonucleotide modulates the expression of a target gene via RISC mediated cleavage of the target sequence.

In some embodiments, a double-stranded region of a double-stranded oligonucleotide is equal to or at least, 10, 11, 12, 13, 14, 15, 16, 17, 18, 19, 20, 21, 22, 23, 23, 24, 25, 26, 27, 28, 29, or 30 nucleotide pairs in length.

In some embodiments, an antisense strand of a double-stranded oligonucleotide is equal to or at least 14, 15, 16, 17, 18, 19, 20, 21, 22, 23, 23, 24, 25, 26, 27, 28, 29, or 30 nucleotides in length.

In some embodiments, a sense strand of a double-stranded oligonucleotide is equal to or at least 10, 11, 12, 13, 14, 15, 16, 17, 18, 19, 20, 21, 22, 23, 23, 24, 25, 26, 27, 28, 29, or 30 nucleotides in length.

In some embodiments, one strand has at least one stretch of 1-5 single-stranded nucleotides in the double-stranded region. By "stretch of single-stranded nucleotides in the double-stranded region" is meant that there is present at least one nucleotide base pair at both ends of the single-stranded stretch. In some embodiments, both strands have at least one stretch of 1-5 (e.g., 1, 2, 3, 4, or 5) single-stranded nucleotides in the double stranded region. When both strands have a stretch of 1-5 (e.g., 1, 2, 3, 4, or 5) single-stranded nucleotides in the double stranded region, such single-stranded nucleotides can be opposite to each other (e.g., a stretch of mismatches) or they can be located such that the second strand has no single-stranded nucleotides opposite to the single-stranded oligonucleotides of the first strand and vice versa (e.g., a single-stranded loop). In some embodiments, the single-stranded nucleotides are present within 8 nucleotides from either end, for example 8, 7, 6, 5, 4, 3, or 2 nucleotide from either the 5' or 3' end of the region of complementarity between the two strands.

In some embodiments, each strand of a double-stranded oligonucleotide utilized in accordance with the present invention has a ZXY structure, such as is described in International Application No. PCT/US2004/07070 filed on Mar. 8, 2004, contents of which are hereby incorporated in their entireties.

Hairpins and Dumbbells

In some embodiments, a double-stranded oligonucleotide utilized in accordance with the present invention is a single molecule that comprises self-complementary regions; thus the two "strands" of a double-stranded regions are in fact covalently linked to one another. Such two strands can be linked to each other at both ends, or at one end only. By linking at one end is meant that 5'-end of first strand is linked to the 3'-end of the second strand or 3'-end of first strand is linked to 5'-end of the second strand. When the two strands are linked to each other at both ends, 5'-end of first strand is linked to 3'-end of second strand and 3'-end of first strand is linked to 5'-end of second strand. In some embodiments, two strands are linked together by an oligonucleotide linker including, but not limited to, $(N)_n$; wherein N is independently a modified or unmodified nucleotide and n is 3-23. In some embodiments, n is 3-10, e.g., 3, 4, 5, 6, 7, 8, 9, or 10. In some embodiments, an oligonucleotide linker is selected from the group consisting of GNRA, $(G)_4$, $(U)_4$, and $(dT)_4$, wherein N is a modified or unmodified nucleotide and R is a modified or unmodified purine nucleotide. In some embodiments, some of the nucleotides in the linker are involved in base-pair interactions with other nucleotides in the linker. In some embodiments, the two strands are linked together by a non-nucleosidic linker, e.g.

In some embodiments, hairpin and dumbbell type RNAi agents have a duplex region equal to or at least 14, 15, 15, 16, 17, 18, 19, 29, 21, 22, 23, 24, or 25 nucleotide pairs. In some embodiments, the duplex region is equal to or fewer than 200, 100, or 50, nucleotide pairs in length. In some embodiments, ranges for the duplex region are about 15 to about 30, about 17 to about 23, about 19 to about 23, and about 19 to about 21 nucleotides pairs in length. In some embodiments, hairpin oligonucleotides mimic the natural precursors of microRNAs.

In some embodiments, hairpin RNAi agents can have a single strand overhang or terminal unpaired region, e.g., at the 3' end on the antisense side of the hairpin, etc. In some embodiments, the overhangs are about 1 to about 4 nucleotides in length. In some embodiments, the overhangs are about 2 to about 3 nucleotides in length.

In some embodiments, a hairpin RNAi agent is characterized in that the 3'-end of an antisense strand is linked to 5'-end of a sense strand. In some embodiments, a hairpin RNAi agent is characterized in that the 5'-end of an antisense strand is linked to the 3'-end of a sense strand. Provided hairpin oligonucleotides are also referred to herein as "shRNA".

Single-Stranded Oligonucleotides

In some embodiments, a single-stranded oligonucleotide utilized in accordance with the present invention comprises a nucleotide sequence that is substantially complementary to a "sense" nucleic acid encoding a gene expression product, e.g., complementary to the coding strand of a double-stranded cDNA molecule or complementary to an RNA sequence, e.g., a pre-mRNA, mRNA, miRNA, or pre-miRNA. Provided single-stranded oligonucleotides include, but are not limited to, antisense oligonucleotides and single-stranded RNAi agents. In some embodiments, the region of complementarity is less than about 30 nucleotides in length. In some embodiments, the region of complementarity is at least about 15 nucleotides in length. In some embodiments, a provided single stranded oligonucleotide is about 10 to about 25 nucleotides in length (e.g., about 11, 12, 13, 14, 15, 16, 18, 19, 20, 21, 22, 23, or 24 nucleotides in length). In some embodiments, a provided single stranded oligonucleotide is about 25 to about 30 nucleotides in length. In some embodiments, a provided single stranded oligonucleotide is about 15 to about 29 nucleotides in length. In some embodiments, a provided single stranded oligonucleotide is characterized as having less than 100% complementarity to a mRNA, RNA or DNA arc. In some embodiments, a provided single-stranded oligonucleotide has a ZXY structure, such as is described in International Application No. PCT/US2004/07070 filed on Mar. 8, 2004.

In some embodiments, a utilized single-stranded oligonucleotide can hybridize to a complementary RNA, e.g., mRNA, pre-mRNA, and prevent access of the translation machinery to the target RNA transcript, thereby preventing protein synthesis. In some embodiments, a provided single-stranded oligonucleotide can hybridize to a complementary RNA and the RNA target can be subsequently cleaved by an enzyme such as RNase H, thus preventing translation of target RNA. In some embodiments, a provided single-stranded oligonucleotide modulates the expression of a target gene via RISC mediated cleavage of the target sequence.

A "single-stranded RNAi agent" as used herein, is an RNAi agent which is made up of a single molecule. In some embodiments, a single-stranded RNAi agent includes a duplexed region, formed by intra-strand pairing, e.g., it is or it includes a hairpin or pan-handle structure. In some embodiments, single-stranded RNAi agents are antisense with regard to the target molecule. In some embodiments, single-stranded RNAi agents are sufficiently long such that they are able to enter the RISC and participate in RISC mediated cleavage of a target mRNA. Exemplary single-stranded siRNAs (ss siRNAs) are known and are described, for example, in U.S. Pat. Pub. No. 2006/0166901, the contents of which are herein incorporated by reference in its entirety.

In some embodiments, a single-stranded RNAi agent is at least about 12 nucleotides in length. In some embodiments, a single-stranded RNAi agent is at least about 15 nucleotides in length. In some embodiments, a single-stranded RNAi agent is at least about 20 nucleotides in length. In some embodiments, a single-stranded RNAi agent is at least about 25 nucleotides in length. In some embodiments, a single-stranded RNAi agent is at least about 29 nucleotides in length. In some embodiments, a single-stranded RNAi agent is at least about 30 nucleotides in length. In some embodiments, a single-stranded RNAi agent is at least about 35 nucleotides in length. In some embodiments, a single-stranded RNAi agent is at least about 40 nucleotides in length. In some embodiments, a single-stranded RNAi agent is at least about 50 nucleotides in length.

In some embodiments, a single-stranded RNAi agent is less than 200 nucleotides in length. In some embodiments, a single-stranded RNAi agent is less than 100 nucleotides in length. In some embodiments, a single-stranded RNAi agent is less than 60 nucleotides in length.

In some embodiments. a single-stranded RNAi agent is 5' phosphorylated. In some embodiments, a single stranded RNAi agent includes a phosphoryl analog at the 5' prime terminus. In certain embodiments, a single-stranded RNAi agent has length from about 15 to about 29 nucleotides in length.

Single-stranded oligonucleotides, including those described and/or identified as single stranded siRNAs, microRNAs or mirs which may be used as targets or may serve as a template for the design of oligonucleotides of the invention are taught in, for example, Esau, et al. US Publication #20050261218 (U.S. Ser. No. 10/909,125) entitled "Oligonucleotides and compositions for use in modulation small non-coding RNAs" the entire contents of which are incorporated herein by reference.

The present invention encompasses research and/or diagnostic reagents that comprise single-stranded oligonucleotides. In some embodiments, a single-stranded oligonucleotide utilized in accordance with the present invention is and/or acts as a primer. In some embodiments, primers are used in polymerase-based chain reactions (i.e., PCR) to amplify nucleic acids. These applications include any known variations of PCR, such as reverse transcription PCR (RT-PCR) and real-time PCR.

MicroRNAs

In some embodiments provided compositions comprise one or more oligonucleotides that are or act as MicroRNAs.

MicroRNAs (miRNAs or mirs) are a highly conserved class of small RNA molecules that are transcribed from DNA in the genomes of plants and animals, but are not translated into protein. Pre-microRNAs are processed into miRNAs. Processed microRNAs are single stranded 17-25 nucleotide (nt) RNA molecules that become incorporated into the RNA-induced silencing complex (RISC) and have been identified as key regulators of development, cell proliferation, apoptosis and differentiation. They are believed to play a role in regulation of gene expression by binding to the 3'-untranslated region of specific mRNAs. RISC mediates downregulation of gene expression through translational inhibition, transcript cleavage, or both. RISC is also implicated in transcriptional silencing in the nucleus of a wide range of eukaryotes.

MicroRNAs have also been implicated in modulation of pathogens in hosts. For example, see Jopling, C. L., et al., Science (2005) vol. 309, pp 1577-1581. Without wishing to be bound by theory, administration of a microRNA, microRNA mimic, and/or anti microRNA oligonucleotide, leads to modulation of pathogen viability, growth, development, and/or replication. In some embodiments, a provided oligonucleotide is a microRNA, microRNA mimic, and/or anti microRNA, wherein microRNA is a host microRNA. The number of miRNA sequences identified to date is large and growing, illustrative examples of which can be found, for example, in: "*miRBase: microRIVA sequences, targets and gene nomenclature*" Griffiths-Jones S, Grocock R J, van Dongen S, Bateman A, Enright A J. NAR, 2006, 34, Database Issue, D140-D144; "*The microRNA Registry*" Griffiths-Jones S. NAR, 2004, 32, Database Issue, D109-D111. Non-limiting examples of useful miRNA sequences are also provided in the accompanying Appendix (C).

Ribozymes

In some embodiments, provided compositions include one or more oligonucleotides that are or act as ribozymes.

Ribozymes are oligonucleotides having specific catalytic domains that possess endonuclease activity (Kim and Cech, Proc Natl Acad Sci USA. 1987 December; 84(24):8788-92; Forster and Symons, Cell. 1987 Apr. 24; 49(2):211-20). At least six basic varieties of naturally occurring enzymatic RNAs are known presently. In general, enzymatic nucleic acids act by first binding to a target RNA. Such binding occurs through the target binding portion of an enzymatic nucleic acid which is held in close proximity to an enzymatic portion of the molecule that acts to cleave the target RNA. Thus, the enzymatic nucleic acid first recognizes and then binds a target RNA through complementary base-pairing, and once bound to the correct site, acts enzymatically to cut the target RNA. Strategic cleavage of such a target RNA will destroy its ability to direct synthesis of an encoded protein. After an enzymatic nucleic acid has bound and cleaved its RNA target, it is released from that RNA to search for another target and can repeatedly bind and cleave new targets.

Methods of producing a ribozyme targeted to any target sequence are known in the art. Ribozymes can be designed as described in, inter alia, Int. Pat. Appl. Publ. No. WO 93/23569 and Int. Pat. Appl. Publ. No. WO 94/02595, each specifically incorporated herein by reference, and synthesized to be tested in vitro and in vivo, as described therein.

Aptamers

In some embodiments, provided compositions include one or more oligonucleotides that are or act as aptamers.

Aptamers are nucleic acid or peptide molecules that bind to a particular molecule of interest with high affinity and specificity (Tuerk and Gold, Science 249:505 (1990); Ellington and Szostak, Nature 346:818 (1990)). DNA or RNA aptamers have been successfully produced which bind many different entities from large proteins to small organic molecules. See Eaton, Curr. Opin. Chem. Biol. 1:10-16 (1997), Famulok, Curr. Opin. Struct. Biol. 9:324-9(1999), and Hermann and Patel, Science 287:820-5 (2000). Aptamers can be RNA or DNA based. Generally, aptamers are engineered through repeated rounds of in vitro selection or equivalently, SELEX (systematic evolution of ligands by exponential enrichment) to bind to various molecular targets such as small molecules, proteins, nucleic acids, and even cells, tissues and organisms. The SELEX procedure is a protocol in which single stranded oligonucleotides are selected from vast libraries of sequences, based on binding affinity at a target protein or other molecule (C. Tuerk, L. Gold, Science, 249 (1990), pp. 505-510; R. Green, A. D. Ellington, D. P. Bartel, J. W. Szostak, Methods Enzymol., 2 (1991), pp. 75-86; L. Gold, B. Polisky, O. Uhlenbeck, M. Yarus, Annu. Rev. Biochem., 64 (1995), pp. 763-797). The SELEX procedure is usually initiated with an RNA or DNA library consisting of some $10^{14}$-$10^{15}$ random oligonucleotide sequences. In a fully randomised oligonucleotide library, each molecule will exhibit a unique tertiary structure which will be dependent on the nucleotide sequence of that molecule. The binding affinity of the oligonucleotide for the target protein will be determined by the fit between moieties on the surface of the oligonucleotide and epitopes on the target protein. As a consequence of starting from a library of vast diversity it is often possible to identify aptamers of nM or sub-nM affinity for the target protein and with selectivity for that target protein over other proteins with a high degree of structural homology (K. W. Uphoff, S. D. Bell, A. D. Ellington, Curr. Opin. Struct. Biol., 6 (1996), pp. 281-288). Using SELEX methodology RNA or DNA aptamers have been generated to many proteins, peptides and small molecules including dopamine (C. Mannironi, A. Di Nardo, P. Fruscoloni, G. P. Tocchini-Valentini, Biochemistry, 36 (1997), pp. 9726-9734), substance P (D. Nieuwlandt, M. Wecker, Biochemistry, 34 (1995), pp. 5651-5659), subtilisin (H. Takeno, S. Yamamoto, T. Tanaka, Y. Sakano, Y. Kikuchi, J. Biochem., 125 (1999), pp. 1115-1119), platelet derived growth factor (L. S. Green, D. Jellinek, R. Jenison, A. Ostman, C-H. Heldin, N. Janjic Biochemistry, 35 (1996), pp. 14413-14424), vascular endothelial growth factor (L. S. Green, D. Jellinek, C. Bell, L. A. Bebe, B. D. Feistner, S. C. Gill, F. M. Jucker, N. Janjic Chem. Biol., 2 (1995), pp. 683-695), thrombin (L. C. Bock, L. C. Griffen, J. A. Latham, E. H. Vermaas, J. J. Toole, Nature, 355 (1992), pp. 564-566), and L-selectin (D. O'Connell, A. Koenig, S. Jennings, B. Hicke, H. L. Han, T. Fitzwater, Y. F. Chang, N. Varki, D. Parma Proc. Natl. Acad. Sci. USA, 93 (1996), pp. 5883-5887).

As reviewed in Dua et al. (2008) Recent Patents on DNA & Gene Sequences, 2: 172-186 (incorporated herein by reference) in more detail, over the years, a number of modified SELEX protocols have been developed. Non-limiting examples of modified SELEX methods are described in the following publications: Counter SELEX (U.S. Pat. No. 5,580,737), Flow cell SELEX (WO9833941), Truncation SELEX (WO0056930), Blended SELEX (U.S. Pat. No. 5,683,867), Transcription free SELEX (US20026387620), Solution SELEX (U.S. Pat. No. 5,567,588), Chimeric SELEX (WO9604403), Tissue SELEX (US20026376474), Photo SELEX (U.S. Pat. No. 6,001,577), Toggle SELEX (US20077312325), Covalent SELEX/Chemi SELEX (U.S. Pat. No. 5,763,595), Genomic SELEX (US20016261774), SELEX without purified protein (WO0224954), CE-SELEX (WO03102212), Mirror-image SELEX—Spiegelmers (EP1386972) and Laser SELEX, DeSELEX (WO07035532), each of which is incorporated herein by reference in its entirety. Stereo-defined oligonucleotides embraced by the present invention may be used in any one or more of the variations of the SELEX methods.

An aptamer can be prepared by any known method, including synthetic, recombinant, and purification methods, and can be used alone or in combination with other aptamers specific for the same target. Further, as described more fully herein, the term "aptamer" specifically includes "secondary aptamers" containing a consensus sequence derived from comparing two or more known aptamers to a given target. Aptamers possess several characteristics that make them attractive therapeutic agents. Both DNA and RNA aptamers have been shown to bind their targets with dissociation constants (Kd) in the low picomolar to low nanomolar range.

Binding of an aptamer is a highly specific interaction that can even discriminate between related proteins that share common structural domains. Though the binding affinity of both aptamers and antibodies is in the same range, aptamers have many additional features which overpower their rival in many cases. Unlike antibodies, aptamers can be targeted even against non immunogenic targets. During synthesis they can be easily subjected to a chemical modification that improves their stability and pharmacokinetics. They display nil to negligible levels of immunogenicity at therapeutic doses due to their resemblance to endogenous molecules.

In some embodiments, oligonucleotides utilized in accordance with the present invention are useful as anti-pathogenic agents, for example, antiviral agents, antibacterial agents, antifungal agents, and so on. Suitable targets for a variety of infectious agents such as viruses and bacteria have been reported. See, for example, U.S. Pat. No. 5,726,017, U.S. Pat. No. 5,654,151, U.S. Pat. No. 5,496,938, U.S. Pat. No. 5,503,978, U.S. Pat. No. 5,587,468, U.S. Pat. No. 5,527,894, US2005233317, U.S. Pat. No. 5,496,938, WO08 066231, JP2002165594, WO002081494, U.S. Pat. No. 5,861,501, WO9720072, U.S. Pat. No. 5,475,096, U.S. Pat. No. 6,569,630, CN101109013, and WO03106476, each of which is incorporated herein by reference in its entirety.

In some embodiments, oligonucleotides utilized in accordance with the present invention are or act as anticancer agents. Any known cancer- or tumor-associated factors, such as proteins involved in the regulation of cell division or proliferation, cell cycle progression, apoptosis, cell migration, DNA repair, etc. including structural proteins and signal transduction molecules, may be targeted by an aptamer. Examples include, without limitation, See, for example, AU Patent 775412, U.S. Pat. No. 6,232,071, WO 08/028534, U.S. Pat. No. 6,933,114, WO 04/081574, AU Patent 242462, U.S. Pat. No. 6,995,249, U.S. Pat. No. 5,668,264, U.S. Pat. No. 6,699,843, WO 04/094614, and U.S. Pat. No. 5,846,713, each of which is incorporated herein by reference in its entirety.

In some embodiments, oligonucleotides utilized in accordance with the present invention are or act as antiangiogenic agents. Non-limiting examples of antiangiogenic targets include VEGF and associates receptors, as well as extracellular matrix or adhesion molecules. See, for example, U.S. Pat. No. 6,051,698, US 2003175703, WO 95/21853 and U.S. Pat. No. 7,094,535, each of which is incorporated herein by reference in its entirety.

In some embodiments, oligonucleotides utilized in accordance with the present invention are or act as anticoagulant agents. Much is known about blood coagulation factors and their function as well as proteins regulation such process. Aptamers are useful in targeting one or more of such factors in treating conditions such as cardiovascular diseases and blood coagulation disorders. See for example, WO 06/033854, U.S. Pat. No. 5,543,293, WO 07/025049, U.S. Pat. No. 6,774,118, WO 07/140000, each of which is incorporated herein by reference in its entirety.

In some embodiments, oligonucleotides utilized in accordance with the present invention are or act as immunomodulatory agents. Aptamers have been generated to target immunomodulatory molecules involved in autoimmune disorders. The present invention may be useful for targeting molecules expressed on immune cells, such as T cells and antigen presenting cells (APCs). See for example, U.S. Pat. No. 5,869,641, WO 01/09160, each of which is incorporated herein by reference in its entirety. In some embodiments, molecules involved in the complement system such as C1, C4, C2, C3 and C5 may be targeted by an aptamer. The complement system has been implicated in numerous renal, rheumatological, neurological, dermatological, hematological, allergic, infectious, and other diseases. See for example, WO 97/28178 and WO 07/103549, each of which is incorporated herein by reference in its entirety. Other immune-related targets include, without limitation, IL-12, IL-23 and IL-28 (see, for example, WO 07/035922, which is incorporated herein by reference), IgE (see, for example, WO 05/113813, which is incorporated herein by reference), Sp-1 and Sp1-, CD28, IL-2, GMCSF (see, for example, U.S. Pat. No. 6,994,959, which is incorporated herein by reference), SDF-1, CXCR4 (see, for example, WO 08/009437, which is incorporated herein by reference), IL-6, IL-12, IFN gamma (see, for example, U.S. Pat. No. 6,589,940 and US2003125279, each of which is incorporated herein by reference), and TLR. Stereo-defined aptamers may elicit improved efficacy against such diseases.

In some embodiments, oligonucleotides utilized in accordance with the present invention are or act as anti-inflammatory agents. Inflammatory disease such as acute respiratory distress syndrome (ARDS), septic shock, pulmonary emphysema, cystic fibrosis, rheumatoid arthritis and chronic bronchitis, have neutrophil elastase involved in their pathogenesis. Human elastate is therefore a target for treating such disorders using an aptamer that regulates inflammation. Other suitable targets include, without limitation, phospholipase A2, such as non-pancreatic secretory PLA2 (see, for example, WO 96/27604, which is incorporated by reference), selectins, E-, P- and L- (see, for example, U.S. Pat. No. 5,780,228, which is incorporated by reference), three homologous C-type lectins, other cell adhesion molecules expressed in cells such as leukocytes, endothelial cells and platelets; MCP-1 (see, for example, WO 07/093409, which is incorporated by reference), NF-kappa B and NF-IL6 (see, for example, WO 00/24404, which is incorporated by reference). Stereo-defined aptamers may elicit improved efficacy against such diseases.

In some embodiments, oligonucleotides utilized in accordance with the present invention are useful for treating certain brain diseases, including but are not limited to: Transmissible spongiform encephalopathies (TSEs) and Alzheimer's disease. Known targets are described in publications including WO 2006/138676 and DE19916417, and WO 08/008884, each of which is incorporated herein by reference. Stereo-defined aptamers may elicit improved efficacy against such diseases.

Decoy Oligonucleotides

In some embodiments, provided compositions include one or more oligonucleotides that are or act as decoy oligonucleotides.

Because transcription factors recognize their relatively short binding sequences, even in the absence of surrounding genomic DNA, short oligonucleotides bearing the consensus binding sequence of a specific transcription factor can be used as tools for manipulating gene expression in living cells. This strategy involves the intracellular delivery of such "decoy oligonucleotides", which are then recognized and bound by the target factor. Occupation of the transcription factor's DNA-binding site by the decoy renders the transcription factor incapable of subsequently binding to the promoter regions of target genes. Decoys can be used as therapeutic agents, either to inhibit the expression of genes that are activated by a transcription factor, or to up-regulate genes that are suppressed by the binding of a transcription factor. Examples of the utilization of decoy oligonucleotides can be found in Mann et al., J. Clin. Invest., 2000, 106: 1071-1075, which is expressly incorporated by reference herein, in its entirety.

miRNA Mimics

In some embodiments, provided compositions include one or more oligonucleotides that are or act as miRNA mimics.

miRNA mimics represent a class of molecules that can be used to imitate the gene modulating activity of one or more miRNAs. Thus, the term "microRNA mimic" refers to synthetic non-coding RNAs (i.e. the miRNA is not obtained by purification from a source of the endogenous miRNA) that are capable of entering the RNAi pathway and regulating gene expression. miRNA mimics can be designed as mature molecules (e.g. single stranded) or mimic precursors (e.g., pri- or pre-miRNAs).

In some embodiments, miRNA mimics are double stranded molecules (e.g., with a duplex region of between about 16 and about 31 nucleotides in length) and contain one or more sequences that have identity with the mature strand of a given miRNA.

In some embodiments, an miRNA mimic comprises a duplex region of between about 16 and about 31 nucleotides. In some embodiments, provided miRNA mimic may contain one or more of the following chemical modification patterns: the sense strand contains 2'-O-methyl modifications of nucleotides 1 and 2 (counting from the 5' end of the sense oligonucleotide), and all of the Cs and Us; the antisense strand modifications can comprise 2' F modification of all of the Cs and Us, phosphorylation of the 5' end of the oligonucleotide, and stabilized internucleotide linkages associated with a 2 nucleotide 3' overhang.

Supermirs

In some embodiments, provided compositions include one or more oligonucleotides that are or act as supermirs.

A supermir refers to an oligonucleotide, e.g., single stranded, double stranded or partially double stranded, which has a nucleotide sequence that is substantially identical to an miRNA and that is antisense with respect to its target. This term includes oligonucleotides which comprise at least one non-naturally-occurring portion which functions similarly. In some embodiments, the supermir does not include a sense strand. In some embodiments, the supermir does not self-hybridize to a significant extent. In some embodiments, a supermir has a secondary structure but is substantially single-stranded under physiological conditions. A supermir that is substantially single-stranded is single-stranded to the extent that less than about 50% (e.g., less than about 40%, 30%, 20%, 10%, or 5%) of the supermir is duplexed with itself. A supermir can include a hairpin segment, e.g., sequence, preferably at the 3' end can self hybridize and form a duplex region, e.g., a duplex region of at least 1, 2, 3, or 4 and preferably less than 8, 7, 6, or 5 nucleotides, e.g., 5 nucleotides. The duplexed region can be connected by a linker, e.g., a nucleotide linker, e.g., 3, 4, 5, or 6 dTs, e.g., modified dTs. In some embodiments, a supermir is duplexed with a shorter oligonucleotide, e.g., of 5, 6, 7, 8, 9, or 10 nucleotides in length, e.g., at one or both of the 3' and 5' end or at one end and in the non-terminal or middle of the supermir.

Antimers or miRNA Inhibitors

In some embodiments, provided compositions include one or more oligonucleotides that are or act as antimers or miRNA inhibitors.

The terms "antimir" "microRNA inhibitor" or "miR inhibitor" are synonymous and refer to oligonucleotides or modified oligonucleotides that interfere with the activity of specific miRNAs. Inhibitors can adopt a variety of configurations including single stranded, double stranded (RNA/RNA or RNA/DNA duplexes), and hairpin designs. In some embodiments, microRNA inhibitors comprise one or more sequences or portions of sequences that are complementary or partially complementary with the mature strand (or strands) of the miRNA to be targeted. In some embodiments, miRNA inhibitors comprise additional sequences located 5' and 3' to the sequence that is the reverse complement of the mature miRNA. Additional sequences can be the reverse complements of the sequences that are adjacent to the mature miRNA in the primiRNA from which the mature miRNA is derived, or additional sequences can be arbitrary sequences (having a mixture of A, G, C, U, or dT). In some embodiments, one or both of the additional sequences are arbitrary sequences capable of forming hairpins. Thus, in some embodiments, the sequence that is the reverse complement of the miRNA is flanked on the 5' side and on the 3' side by hairpin structures. In some embodiments, microRNA inhibitors are double stranded. In some embodiments, microRNA inhibitors are double stranded and include mismatches between nucleotides on opposite strands. In some embodiments, microRNA inhibitors are linked to conjugate moieties in order to facilitate uptake of the inhibitor into a cell.

MicroRNA inhibitors, including hairpin miRNA inhibitors, are described in detail in Vermeulen et al., "Double-Stranded Regions Are Essential Design Components Of Potent Inhibitors of RISC Function," RNA 13: 723-730 (2007) and in WO2007/095387 and WO 2008/036825 each of which is incorporated herein by reference in its entirety.

An exemplary application of miRNA-based therapy is described in Pan et al. (2007) World J Gastroenterol 13(33): 4431-36, "New therapeutic opportunities for Hepatitis C based on small RNA," the contents of which are incorporated by reference. Briefly, the authors describe 22 nucleotide mature miR-122, derived from a noncoding polyadenylated RNA transcript of the hcr gene, which is a liver-specific developmental regulator. Because miR-122 is a liver specific miRNA that is involved in HCV viral replication, silencing of miR-122 can be useful for the treatment of HCV.

Antagomirs

In some embodiments, provided compositions include one or more oligonucleotides that are or act as antagomirs.

Antagomirs are RNA-like oligonucleotides that harbor various modifications for RNAse protection and pharmacologic properties, such as enhanced tissue and cellular uptake. They differ from normal RNA by, for example, complete 2'-O-methylation of sugar, phosphorothioate intersugar linkage and, for example, a cholesterol-moiety at 3'-end. In some embodiments, an antagomir comprises a 2'-O-methylmodification at all nucleotides, a cholesterol moiety at 3'-end, two phosphorothioate intersugar linkages at the first two positions at the 5'-end and four phosphorothioate linkages at the 3'-end of the molecule. Antagomirs can be used to efficiently silence endogenous miRNAs by forming duplexes comprising the antagomir and endogenous miRNA, thereby preventing miRNA-induced gene silencing. An example of antagomir-mediated miRNA silencing is the silencing of miR-122, described in Krutzfeldt et al, Nature, 2005, 438: 685-689, which is incorporated by reference herein in its entirety.

Modified Single Oligonucleotide Variations

Typically, it is perceived that two components are required to activate RNAi machinery—the double-stranded nucleic acid motif, which is required for recognition by RNAi-associated proteins and the guide strand which serves as the mRNA binding co-factor in the RISC's Argonaute catalytic protein. More recently, a novel type of RNAi molecules composed of a single, short (25-28 nt) oligo capable of self-dimerizing into a partially complementary duplex have been developed. These molecules were demonstrated to efficiently activate the RISC and to produce target mRNA silencing comparable to that obtained with potent conventional RNAi molecules. See: Lapierre et al., "Potent and systematic RNAi mediated silencing with single oligonucleotide compounds." RNA 2011; 17:00, the contents of which are hereby incorporated by reference. See also: WO 2010/090762 "RNA DUPLEXES WITH SINGLE STRANDED PHOSPHOROTHIOATE NUCLEOTIDE REGIONS FOR ADDITIONAL FUNCTIONALITY" (PCT/US2010/00348), the contents of which are hereby incorporated by reference.

Thus, the present invention includes RNAi constructs containing single stranded regions of phosphorothioate modified nucleotides, and the uses of such constructs in gene silencing.

In some embodiments, the invention utilizes isolated double stranded nucleic acid molecules including a guide strand and a passenger strand, wherein the passenger strand is connected through a cleavable linker to a single stranded region of at least eight phosphorothioate modified nucleotides. In some embodiments, the invention is an isolated double stranded nucleic acid molecule having a guide strand and a passenger strand, wherein at least one of the guide strand and passenger strand is connected through a cleavable linker to a single stranded region of at least six phosphorothioate modified nucleotides.

In some embodiments, the invention utilizes an isolated double stranded nucleic acid molecule having a guide strand and a passenger strand, wherein at least one of the guide strand and passenger strand is connected through a cleavable linker to a single stranded region of at least three phosphorothioate modified nucleotides. In some embodiments, the double stranded nucleic acid molecule includes at least one of the following properties. The passenger strand may be 8-18 nucleotides in length. The nucleic acid may have at least one 2' O methyl or 2' fluoro modification. The cleavable linkage may be other than a nucleotidic linkage. The nucleic acid may include a lipophilic group. The guide strand may be 16-18 nucleotides or 26-28 nucleotides in length. In some embodiments the single stranded region is connected to the guide strand.

In some embodiments, the cleavable linker includes one or more unmodified nucleotides. In other embodiments, the cleavable linker is a phosphodiester bond. In certain embodiments, the cleavable linker is S—S. In some embodiments the cleavable linker is DNA or RNA. The single stranded region of at least eight phosphorothioate modified nucleotides can be at either the 3' or 5' end of the passenger strand. In some embodiments, the single stranded region of at least eight phosphorothioate modified nucleotides is DNA, while in other embodiments it is RNA.

In some embodiments the double stranded region of the nucleic acid molecule is a perfect duplex. In other embodiments the double stranded region contains at least one bulge region. In some embodiments the passenger strand comprises a nick within the double stranded region of the molecule. The double stranded region may contain at least one nucleotide that is phosphorothioate modified.

Nucleic acid molecules utilized in accordance with the invention may be chemically modified. In certain embodiments the chemical modification is 2'Omethyl and/or 2'Fluoro. In some embodiments more than one chemical modification is present in the same molecule. In some embodiments chemical modification increases stability, increases evasion of immune regulation, and/or prevents off-target gene silencing. Chemical modification can be present on the passenger strand and/or the guide strand. In some embodiments the single stranded region of at least eight phosphorothioate modified nucleotides is cleaved from the double stranded region of the nucleic acid molecule in a cell. In some embodiments the single stranded region of at least eight phosphorothioate modified nucleotides has complementarity to a mammalian gene. In certain embodiments the single stranded region of at least eight phosphorothioate modified nucleotides functions as an antisense molecule. The double stranded region may be at least 19 nucleotides long. In some embodiments the single stranded region is at least 12 nucleotides long.

In some embodiments, the invention utilizes bifunctional nucleic acid molecule including a double stranded region that functions in RNA interference and a single stranded region that functions in antisense, wherein the double stranded region comprises a guide strand and a passenger strand, and wherein the double stranded region and the single stranded region are connected through a cleavable linker. In some embodiments, the cleavable linker includes one or more unmodified nucleotides. In other embodiments, the cleavable linker is a phosphodiester bond. In certain embodiments, the cleavable linker is S—S. In some embodiments the cleavable linker is DNA or RNA.

In some embodiments, the invention relates to methods for inhibiting the expression of a target gene in a mammalian cell, including contacting the mammalian cell with an isolated double stranded nucleic acid molecule comprising a guide strand and a passenger strand, wherein the passenger strand is connected through a cleavable linker to a single stranded region of at least eight phosphorothioate modified nucleotides. In some embodiments, the cleavable linker includes one or more unmodified nucleotides. In other embodiments, the cleavable linker is a phosphodiester bond. In certain embodiments, the cleavable linker is S—S. In some embodiments the cleavable linker is DNA or RNA.

In some embodiments, the single stranded region comprises at least eight phosphorothioate modified nucleotides and can be at either the 3' or 5' end of the passenger strand. In some embodiments, the single stranded region of at least eight phosphorothioate modified nucleotides is DNA, while in other embodiments it is RNA. In some embodiments the double stranded region of the nucleic acid molecule is a perfect duplex. In other embodiments the double stranded region contains at least one bulge region. In some embodiments the passenger strand comprises a nick within the double stranded region of the molecule. The double stranded region may contain at least one nucleotide that is phosphorothioate modified.

Nucleic acid molecules utilized in accordance with the invention may be chemically modified. In certain embodiments the chemical modification is 2'Omethyl and/or 2'Fluoro. In some embodiments more than one chemical modification is present in the same molecule. In some embodiments chemical modification increases stability, increases evasion of immune regulation, and/or prevents off-target gene silencing. Chemical modification can be present on the passenger strand and/or the guide strand.

In some embodiments the single stranded region of at least eight phosphorothioate modified nucleotides is cleaved from the double stranded region of the nucleic acid molecule in a cell. In some embodiments the single stranded region of at least eight phosphorothioate modified nucleotides has complementarity to a mammalian gene. In certain embodiments the single stranded region of at least eight phosphorothioate modified nucleotides functions as an antisense molecule. The double stranded region may be at least 19 nucleotides long. In some embodiments the single stranded region is at least 12 nucleotides long.

In some embodiments, the invention relates to methods for inhibiting the expression of a target gene in a mammalian cell, comprising contacting the mammalian cell with an isolated double stranded nucleic acid molecule comprising a guide strand and a passenger strand, wherein the guide strand is connected through a cleavable linker to a single stranded region of at least eight phosphorothioate modified nucleotides. In some embodiments, the cleavable linker includes one or more unmodified nucleotides. In other embodiments, the cleavable linker is a phosphodiester bond. In certain embodiments, the cleavable linker is S—S. In some embodiments the cleavable linker is DNA or RNA.

In some embodiments, the invention relate to methods for inhibiting the expression of a target gene in a mammalian cell, including contacting the mammalian cell with a bifunctional nucleic acid molecule including a double stranded region that functions in RNA interference and a single stranded region that functions in antisense, wherein the double stranded region includes a guide strand and a passenger strand, and wherein the double stranded region and the single stranded region are connected through a cleavable linker. In other aspects a method for inhibiting the expression of a target gene in a mammalian cell is provided. The method involves contacting the mammalian cell with any of the isolated double stranded nucleic acid molecules described herein.

In some embodiments, isolated double stranded nucleic acid molecules utilized in accordance with the present invention include a chemical modification that increases stability. In some embodiments, isolated double stranded nucleic acid molecules include a chemical modification that increases evasion of immune regulation. In some embodiments, the isolated double stranded nucleic acid molecules include a chemical modification that prevents off-target gene silencing.

In some embodiments, as discussed herein, utilized oligonucleotides are single oligonucleotide molecules capable of self-dimerizing into a partially complementary duplex. In some embodiments, such single oligonucleotides are about 23-30 nucleotides in length, e.g., 23, 24, 25, 26, 27, 28, 29, and 30. In some embodiments, single oligonucleotides capable of self-dimerizing into a partially complementary duplex contain about 14-18 nucleotide mRNA targeting region, e.g., 14, 15, 16, 17, and 18. In some embodiments, single oligonucleotides capable of self-dimerizing into a partially complementary duplex contain an additional 7-11, e.g., 7, 8, 9, 10, and 11 nucleotides to enable self-dimerization into a partially complementary duplex. In some embodiments, single oligonucleotides capable of self-dimerizing into a partially complementary duplex can efficiently enter and activate the RNA-induced silencing complex (RISC).

UI Adaptors

In some embodiments, provided compositions include one or more oligonucleotides that are or act as U1 adaptors.

UI adaptors inhibit polyA sites and are bifunctional oligonucleotides with a target domain complementary to a site in the target gene's terminal exon and a 'UI domain' that binds to the UI smaller nuclear RNA component of the UI snRNP. See for example, Int. Pat. App. Pub. No. WO2008/121963 and Goraczniak, et al., 2008, Nature Biotechnology, 27(3), 257-263, each of which is incorporated by reference herein, in its entirety. UI snRNP is a ribonucleoprotein complex that functions primarily to direct early steps in spliceosome formation by binding to the pre-mRNA exon-intron boundary, Brown and Simpson, 1998, Annu Rev Plant Physiol Plant Mol Biol 49:77-95.

In some embodiments, a utilized oligonucleotide is a UI adaptor, wherein the oligonucleotide comprises at least one annealing domain (targeting domain) linked to at least one effector domain (U1 domain), wherein the annealing domain hybridizes to a target gene sequence and the effector domain hybridizes to the UI snRNA of UI snRNP. In some embodiments, the UI adaptor comprises one annealing domain. In some embodiments, the UI adaptor comprises one effector domain.

Without wishing to be bound by theory, the annealing domain will typically be from about 10 to about 50 nucleotides in length, more typically from about 10 to about 30 nucleotides or about 10 to about 20 nucleotides. In some embodiments, the annealing, domain is 10, 11, 12, 13, 14, 15, 16, 17, 18, 19, 20, or 21 nucleotides in length. The annealing domain may be at least 75%, at least 80%, at least 85%, at least 90%, at least 95%, at least 97%, or at least about 100% complementary to the target gene. In some embodiments, the annealing domain hybridizes with a target site within the Y terminal exon of a pre-MRNA, which includes the terminal coding region and the 3'UTR and polyalenylation signal sequences (e.g., through the polyadenyiation site). In some embodiments, the target sequence is within about 500 basepair, about 250 basepair, about 100 basepair, or about 50 basepair of the poly (A) signal sequence of the, pre-mRNA. In some embodiments, the annealing domain comprises 1, 2, 3, or 4, mismatches with the target gene sequence.

In some embodiments, the effector domain is from about 8 nucleotides to about 30 nucleotides in length. In some embodiments, the effector domain is from about 10 nucleotides to about 20 nucleotides in length. In some embodiments, the effector domain is from about 10 nucleotides to about 15 nucleotides in length. The U1 domain can hybridize with UI snRNA, particularly the 5' end and more specifically nucleotides 2-11. In some embodiments, the UI domain, is perfectly complementary to nucleotides 2-11 of endogenous U1 snRNA. In some embodiments, the U1 domain comprises a nucleotide sequence selected from the group consisting of SEQ. ID NO: 2299 (5'-GCCAG-GUAAGUAU-3'), SEQ ID NO: 2300 (5'-CCAG-GUAAGUAU-3'), SEQ ID. NO: 2301 (5'-CAG-GUAAGUAU-3'), SEQ ID NO: 2302 (5'-CAGGUAAGU-3'), SEQ ID NO: 2303 (5'-CAGGUAAG-3'), and SEQ ID NO: 7-2304 (5'-CAGGUAA-3'). In some embodiments; the III domain comprises a nucleotide sequence, SEQ ID NO: 2305 (5'-CAGGUAAGUA-3'). Without wishing to be bound by theory, increasing the length of the U1 domain to include basepairing into stem 1 and/or basepairing to position 1 of U1 snRNA improves the U1 adaptor's affinity to UI snRNA.

The annealing and effector domains of the UI adaptor can be linked such that the effector domain is at the 5' end and/or 3' end of the annealing domain. The two domains can be linked by such that the 3' end of one domain is linked to 5' end of the other domain, or 3' end of one domain is linked to 3' end of the other domain, or 5' end of one domain is linked to 5' end of the other domain. The annealing and effector domains can be linked directly to each other or by a nucleotide based or non-nucleotide based linker. In some embodiments, a linker is nucleotide base and comprises 1, 2, 3, 4, 5, 6, 7, 8, 9, 10, up to 15, up to 20, or up to 25 nucleotides.

In some embodiments, a linker between an annealing domain and an effector domain is multivalent, e.g., trivalent, tetravalent. pentavalent. Without wishing to be bound by theory, a multivalent linker can be used to link together a single annealing domain with a plurality of adaptor domains.

In some embodiments, a UI adaptor comprises any oligonucleotide modification described herein. Exemplary such modifications include those that increase annealing affinity, specificity, bioavailability in the cell and organism, cellular and/or nuclear transport, stability, and/or resistance to degradation. In some embodiments, the U1 adaptor can be administered in combination with at least one other RNAi agent.

RNA Activators

In some embodiments, provided compositions include one or more oligonucleotides that are or act as RNA activators.

Recent studies have found that dsRNA can also activate gene expression, a mechanism that has been termed "small RNA-induced gene activation" or RNAa. See for example Li, L. C. et al. *Proc Nati Auld Sci USA*. (2006), 103(46): 17337-42 and Li L. C. (2008). "Small RNAMediated Gene Activation". RNA and the Regulation of Gene Expression: A Hidden Layer of Complexity. Caister Academic Press. ISBN 978-1-904455-25-7. It has been shown that dsRNAs targeting gene promoters induce potent transcriptional activation of associated genes. Endogenous miRNA that cause RNAa has also been found in humans. Check E. Nature (2007). 448 (7156): 855-858.

Another observation is that gene activation by RNAa is long-lasting. Induction of gene expression has been seen to last for over ten days. The prolonged effect of RNAa could be attributed to epigenetic changes at dsRNA target sites.

In some embodiments, a provided oligonucleotide is an RNA activator, wherein a provided oligonucleotide increases the expression of a gene. In some embodiments, increased gene expression inhibits viability, growth development, and/or reproduction.

Non-Coding RNAs (ncRNAs)

The present invention encompasses non-coding RNAs, such as long non-coding RNAs (lncRNAs) and short non-coding RNAs (sncRNAs).

Accordingly, provided oligonucleotide compositions of the present invention may be useful for modulating disease-associated long non-coding RNA. In some embodiments, oligonuclotides synthesized according to the methods provided herein are used to specifically block the binding of transcriptional repressor complexes to target lncRNA regions, thereby inducing the expression of the associated target gene. In some embodiments, the transcriptional repressor complex is a silencing factor. In some embodiments, the transcriptional repressor complex has Histone methyltransferase activity. In some embodiments, the transcriptional repressor complex methylates histone H3. In some embodiments, the transcriptional repressor complex is PRC2 (Polycomb Repressive Complex 2).

Certain PRC2-associated lncRNAs have been reported to be potential therapeutic targets and/or biomarkers (Zhao et al., 2010. "Genome-wide Identification of Polycomb-Associated RNAs by RIP-seq" Molecular Cell 40: 939-53). Overexpression of PCR2 proteins have been linked to various types of cancer, including metastatic prostate and breast cancer, and cancers of the colon, breast, and liver. Pharmacological inhibition of PRC2-mediated gene repression was found to induce apoptosis in several cancer cell lines in vitro, but not in various types of normal cells. Induction of apoptosis in this system is dependent on reactivation of genes that had been repressed by PRC2. There is also evidence that PRC2-mediated gene repression may be linked to the maintenance of the stem-cell properties of cancer stem cells. These results suggest that at least in some cases, inhibition of PRC2-mediated gene repression-including via targeting lncRNAs that recruit PRC2 to critical genes—is a potential strategy for treating various types of cancer. Non-limiting sequences of nucleic acids, which can be prepared in accordance with the methods provided herein, can be found in, for example, International Patent Publication WO 2012/065143 entitled "Polycomb-associated non-coding RNAs" (PCT/US2011/60493), the contents of which are incorporated by reference herein.

Provided oligonucleotide compositions of the present invention may be or act as small non-coding RNAs, such as piwi-interacting RNAs (piRNAs). The piRNAs represent the largest class of small non-coding RNA molecules that is expressed in animal cells and are found in clusters throughout the genome. piRNAs are known to form RNA-protein complexes through interactions with piwi proteins. piRNA complexes have been implicated in both epigenetic and post-transcriptional gene silencing of retrotransposons and other genetic elements in germ cells, including spermatogenesis. Typically piRNAs are 26-31 nucleotides in length, and, as compared to typical miRNAs, they lack sequence conservation and exhibit higher complexity. In some embodiments, oligonucleotide compositions utilized in accordance with the present invention comprise 5' uridine. In some embodiments, oligonucleotide compositions utilized in accordance with the present invention comprise 5' monophosphoate and a 3' modification that acts to block either the 2' or 3' oxygen. In some embodiments, the 3' modification is a 2'-O-methylation.

Triplex Forming Oligonucleotides

In some embodiments, provided compositions include one or more oligonucleotides that are or act as triplex-forming oligonucleotides.

Recent studies have shown that triplex forming oligonucleotides (TFO) can be designed which can recognize and bind to polypurine/polypyrimidine regions in double-stranded helical DNA in a sequence-specific manner. These recognition rules are outline by Maher III, L. J., et al., *Science* (1989) vol. 245, pp 725-730; Moser, H. E., et al., *Science* (1987) vol. 238, pp 645-630; Beal, P. A., et al., *Science* (1992) vol. 251, pp 1360-1363; Conney, M., et al., *Science* (1988) vol. 241, pp 456-459 and Hogan, M. E., et al., EP Publication 375408. Modification of the oligonucleotides, such as the introduction of intercalators and inter-sugar linkage substitutions, and optimization of binding conditions (pH and cation concentration) have aided in. overcoming inherent obstacles to TFO activity such as charge repulsion and instability, and it was recently shown that oligonucleotides can be targeted to specific sequences (for a recent review sec Seidman and Glazer, Clin Invest 2003 2:487-94). In general the triplex-forming oligonucleotide has the sequence correspondence:

```
oligo  3'-A G G T
duplex 5'-A G C T
duplex 3'-T C G A
```

However, it has been shown that the A-AT and G-GC triplets have the greatest triple helical stability (Reither and Jeltsch, BMC Biochem, 2002, Sep. 12, Epub). The same authors have demonstrated that TFOs designed according to the A-AT and G-GC rule do not form nonspecific triplexes, indicating that the triplex formation is indeed sequence specific. Thus for any given sequence a triplex forming sequence can be devised. In some embodiments, triplex-forming oligonucleotides are at least about 15, about 25, or about 30 or more nucleotides in length. In some embodiments, triplex-forming oligonucleotides are up to about 50 or about 100 nucleotides in length.

Formation of the triple helical structure with the target DNA induces steric and functional changes, blocking transcription initiation and elongation, allowing the introduction of desired sequence changes in the endogenous DNA and resulting in the specific down-regulation of gene expression. Examples of such suppression of gene expression in cells treated with TFOs include knockout of episomal supFGI and endogenous HPRT genes in mammalian cells (Vasquez et al., Nucl Acids Res. 1999; 27: 1176-81, and Purl, et al, J Biol Chem, 2001; 276:28991-98), and the sequence- and target specific downregulation of expression of the Ets2 transcription factor, important in prostate cancer etiology (Carbone, et al, Nucl Acid Res. 2003; 31:833-43), and the pro-inflammatory ICAM-I gene (Besch et al, J Biol Chem, 2002; 277:32473-79). In addition, Vuyisich and Beal have recently shown that sequence specific TFOs can bind to dsRNA, inhibiting activity dsRNA-dependent enzymes such as RNA-dependent kinases (Vuyisich and Beal, Nuc. Acids Res 2000; 28:2369-74).

Additionally, TFOs designed according to the abovementioned principles can induce directed mutagenesis capable of effecting DNA repair, thus providing both down-regulation and up-regulation of expression of endogenous genes (Seidman and Glazer, J Invest 2003; 112:487-94). Detailed description of the design, synthesis and administration of effective TFOs can be found. S. Pat. App. Nos. 2003 017068 and 2003 0096980 to Froehier et at and 2002 012821/8 and 2002 0123476 to Emanude et al, and U.S. Pat. No. 5,721,138 to Lawn, the contents of which are herein incorporated in their entireties.

Conjugates/Linkers

The invention also contemplates that utilized oligonucleotides, in some embodiments, are optimized for cellular uptake. In any utilized oligonucleotides embraced by the present invention, guide and/or passenger strands may be attached to a conjugate. In some embodiments the conjugate is hydrophobic. The hydrophobic conjugate can be a small molecule with a partition coefficient that is higher than 10. The conjugate can be a sterol-type molecule such as cholesterol, or a molecule with an increased length polycarbon chain attached to C17, and the presence of a conjugate can influence the ability of an RNA molecule to be taken into a cell with or without a lipid transfection reagent. The conjugate can be attached to the passenger or guide strand through a hydrophobic linker. In some embodiments, a hydrophobic linker is 5-12C in length, and/or is hydroxypyrrolidine-based. In some embodiments, a hydrophobic conjugate is attached to the passenger strand and the CU residues of either the passenger and/or guide strand are modified. In some embodiments, at least 50%, 55%, 60%, 65%, 70%, 75%, 80%, 85%, 90% or 95% of the CU residues on the passenger strand and/or the guide strand are modified. In some aspects, molecules associated with the invention are self-delivering (sd). As used herein, "self-delivery" refers to the ability of a molecule to be delivered into a cell without the need for an additional delivery vehicle such as a transfection reagent. Aspects of the invention relate to selecting molecules for use in RNAi.

In any of the embodiments embraced herein, utilized oligonucleotides may be associated with a hydrophobic moiety for targeting and/or delivery of the molecule to a cell. In some embodiments, the hydrophobic moiety is associated with the nucleic acid molecule through a linker. In some embodiments, the association is through non-covalent interactions. In other some, the association is through a covalent bond. Any linker known in the art may be used to associate the nucleic acid with the hydrophobic moiety. Linkers known in the art are described in published international PCT applications, WO 92/03464, WO 95/23162, WO 2008/021157, WO 2009/021157, WO 2009/134487, WO 2009/126933, U.S. Patent Application Publication 2005/0107325, U.S. Pat. No. 5,414,077, U.S. Pat. No. 5,419,966, U.S. Pat. No. 5,512,667, U.S. Pat. No. 5,646,126, and U.S. Pat. No. 5,652,359, which are incorporated herein by reference. The linker may be as simple as a covalent bond to a multi-atom linker. The linker may be cyclic or acyclic. The linker may be optionally substituted. In some embodiments, the linker is capable of being cleaved from the nucleic acid. In certain embodiments, the linker is capable of being hydrolyzed under physiological conditions. In some embodiments, the linker is capable of being cleaved by an enzyme (e.g., an esterase or phosphodiesterase). In some embodiments, the linker comprises a spacer element to separate the nucleic acid from the hydrophobic moiety. The spacer element may include one to thirty carbon or heteroatoms. In certain embodiments, the linker and/or spacer element comprises protonatable functional groups. Such protonatable functional groups may promote the endosomal escape of the nucleic acid molecule. The protonatable functional groups may also aid in the delivery of the nucleic acid to a cell, for example, neutralizing the overall charge of the molecule. In some embodiments, the linker and/or spacer element is biologically inert (that is, it does not impart biological activity or function to the resulting nucleic acid molecule).

The hydrophobic molecule may be connected to the polynucleotide by a linker moiety. Optionally the linker moiety is a non-nucleotidic linker moiety. Non-nucleotidic linkers are e.g. abasic residues (dSpacer), oligoethyleneglycol, such as triethyleneglycol (spacer 9) or hexaethylenegylcol (spacer 18), or alkane-diol, such as butanediol. The spacer units are preferably linked by phosphodiester or phosphorothioate bonds. The linker units may appear just once in the molecule or may be incorporated several times, e.g. via phosphodiester, phosphorothioate, methylphosphonate, or amide linkages.

Typical conjugation protocols involve the synthesis of polynucleotides bearing an aminolinker at one or more positions of the sequence, however, a linker is not required. The amino group is then reacted with the molecule being conjugated using appropriate coupling or activating reagents. The conjugation reaction may be performed either with the polynucleotide still bound to a solid support or following cleavage of the polynucleotide in solution phase. Purification of the modified polynucleotide by HPLC typically results in a pure material.

In some embodiments, a linking group can be attached to a nucleomonomer and the transporting peptide can be covalently attached to the linker. In some embodiments, a linker can function as both an attachment site for a transporting peptide and can provide stability against nucleases. Examples of suitable linkers include substituted or unsubstituted $C_1$-$C_{20}$ alkyl chains, $C_2$-$C_{20}$ alkenyl chains, $C_2$-$C_{20}$ alkynyl chains, peptides, and heteroatoms (e.g., S, O, NH, etc.). Other exemplary linkers include bifunctional cross-linking agents such as sulfosuccinimidyl-4-(maleimidophenyl)-butyrate (SMPB) (see, e.g., Smith et al. Biochem J 1991. 276: 417-2).

In some embodiments, provided oligonucleotides of the invention are synthesized as molecular conjugates which utilize receptor-mediated endocytotic mechanisms for delivering genes into cells (see, e.g., Bunnell et al. 1992. Somatic Cell and Molecular Genetics. 18:559, and the references cited therein).

Targeting Agents

In some embodiments, provided compositions include one or more targeting agents, associated with the composition and/or with individual oligonucleotides therein. Exemplary such targeting agents are described above and further herein. The phrases "targeting agent" and "targeting moiety" are used herein interchangeably.

Delivery of oligonucleotides and/or compositions thereof can often be improved by targeting the oligonucleotides to a cellular receptor. The targeting moieties can be conjugated to the oligonucleotides or attached to a carrier group (i.e., poly(L-lysine) or liposomes) linked to the oligonucleotides. This method is well suited to cells that display specific receptor-mediated endocytosis.

For instance, oligonucleotide conjugates to 6-phosphomannosylated proteins are internalized 20-fold more efficiently by cells expressing mannose 6-phosphate specific receptors than free oligonucleotides. The oligonucleotides may also be coupled to a ligand for a cellular receptor using a biodegradable linker. In another example, the delivery construct is mannosylated streptavidin which forms a tight complex with biotinylated oligonucleotides. Mannosylated streptavidin was found to increase 20-fold the internalization of biotinylated oligonucleotides. (Vlassov et al. 1994. Biochimica et Biophysica Acta 1197:95-108).

The field of RNA interference has revolutionized the study of biological processes. These tools include small inhibitory RNA (siRNA), small hairpin RNA (shRNA) and ribozymes. As RNA interference technology has grown, so has the list of validated RNA target sequences and reagents for use. Provided compositions and methods embraced by the present application can be readily applied to each of such target sequences. For a database of validated siRNA target sequences and links to kits and reagents that may be used for RNA interference experiments, see, for example, http://www.rnainterference.org/index.html. Exemplary siRNA target sequences useful for the present invention are provided in the accompanying Appendix (A).

Immunomodulatory Oligonucleotides

In some embodiments, provided compositions include one or more oligonucleotides that are or act as immunomodulatory oligonucleotides.

Oligonucleotides utilized in accordance with the invention can be immunomodulatory agents, i.e., agents that are capable of modulating or regulating an immune response when administered to a subject. Immune responses elicited by such an agent can be an innate and/or an adaptive immune response. The immune system is divided into a more innate immune system, and acquired adaptive immune system of vertebrates, the latter of which is further divided into humoral cellular components. In some embodiments, the immune response can be mucosal. Immunomodulatory motifs described herein can be used in the context of previously described classes of immunomodulatory oligonucleotides including ODN classes such as A class, B class, C class, E class, T class and P class.

In some embodiments of the invention immunomodulatory oligonucleotides utilized in accordance with the present invention include one or more immunostimulatory motifs. In some embodiments, oligonucleotides utilized in accordance with the present invention include one or more "CpG dinucleotides." A CpG dinucleotide can be methylated or unmethylated. An immunostimulatory oligonucleotide containing at least one unmethylated CpG dinucleotide is an oligonucleotide molecule which contains an unmethylated cytosine-guanine dinucleotide sequence (i.e., an unmethylated 5' cytidine followed by 3' guanosine and linked by a phosphate bond) and which activates the immune system; such an immunostimulatory oligonucleotide is a CpG oligonucleotide. CpG oligonucleotides have been described in a number of issued patents, published patent applications, and other publications, including: U.S. Pat. Nos. 6,194,388; 6,207,646; 6,214,806; 6,218,371; 6,239,116; and 6,339,068, the contents of which are incorporated herein by reference. In some embodiments, utilized oligonucleotides are or act as an agonist for a Toll-like receptor. In some embodiments, utilized oligonucleotides are or act as an agonist for Toll-like receptor 9 (TLR9). In some embodiments, utilized oligonucleotides are or act as an antagonist for a Toll-like receptor. In some embodiments, utilized oligonucleotides are or act as an antagonist for Toll-like receptor 9 (TLR9). In some embodiments, stereo-defined oligonucleotides embraced by the invention exhibit greater affinity for respective receptor/target, as compared to stereo-random counterpart. In some embodiments, stereo-defined oligonucleotides embraced by the invention elicit one or more immune responses, when administered to subjects that meet certain clinical criteria, with less degree of variables amongst the population, as compared to stereo-random counterpart. In some embodiments, stereo-defined oligonucleotides embraced by the invention cause less degree of toxic side effects or fewer side effects, when administered to subjects that meet certain clinical criteria, as compared to stereo-random counterpart.

In some embodiments, immunostimulatory oligonucleotides utilized in accordance with the present invention are free of CpG dinucleotide motifs. These oligonucleotides which are free of CpG dinucleotides are referred to as non-CpG oligonucleotides, and they have non-CpG immunostimulatory motifs. In some embodiments, these are T-rich immunostimulatory oligonucleotides, such as oligonucleotides having at least 80% T.

In some embodiments, immunostimulatory oligonucleotides utilized in accordance with the present invention are B class immunomodulatory oligonucleotides.

"B class" ODN are potent at activating B cells but are relatively weak in inducing IFN-α and NK cell activation. The B class CpG oligonucleotides typically are fully stabilized and include an unmethylated CpG dinucleotide within certain preferred base contexts. See, e.g., U.S. Pat. Nos. 6,194,388; 6,207,646; 6,214,806; 6,218,371; 6,239,116; and 6,339,068.

Another class is potent for inducing IFN-α and NK cell activation but is relatively weak at stimulating B cells; this class has been termed the "A class". In some embodiments, immunostimulatory oligonucleotides utilized in accordance with the present invention are A class immunomodulatory oligonucleotides. The A class CpG oligonucleotides typically have stabilized poly-G sequences at 5' and 3' ends and a palindromic phosphodiester CpG dinucleotide-containing sequence of at least 6 nucleotides. See, for example, published patent application PCT/US00/26527 (WO 01/22990).

Yet another class of CpG oligonucleotides activates B cells and NK cells and induces IFN-α; this class has been termed the C-class. In some embodiments, immunostimulatory oligonucleotides utilized in accordance with the present invention are C class immunomodulatory oligonucleotides. The "C class" immunostimulatory oligonucleotides contain at least two distinct motifs have unique and desirable stimulatory effects on cells of the immune system. Some of these ODN have both a traditional "stimulatory" CpG sequence and a "GC-rich" or "B-cell neutralizing" motif. These combination motif oligonucleotides have immune stimulating effects that fall somewhere between those effects associated with traditional "class B" CpG ODN, which are strong inducers of B cell activation and dendritic cell (DC) activation, and those effects associated with a more recently described class of immune stimulatory oligonucleotides ("class A" CpG ODN) which are strong inducers of IFN-α and natural killer (NK) cell activation but relatively poor inducers of B-cell and DC activation. Krieg A M et al. (1995) Nature 374:546-9; Ballas Z K et al. (1996) J Immunol 157:1840-5; Yamamoto S et al. (1992) J Immunol 48:4072-6. While preferred class B CpG ODN often have phosphorothioate backbones and preferred class A CpG ODN have mixed or chimeric backbones, the C class of combination motif immune stimulatory oligonucleotides may have either stabilized, e.g., phosphorothioate, chimeric, or phosphodiester backbones, and in some preferred embodiments, they have semi-soft backbones. This class has been described in U.S. patent application Ser. No. 10/224,523 filed on Aug. 19, 2002, the entire contents of which is incorporated herein by reference.

In some embodiments, immunostimulatory oligonucleotides utilized in accordance with the present invention are E class immunomodulatory oligonucleotides. The "E class" oligonucleotides have an enhanced ability to induce secretion of IFN-alpha. These ODN have a lipophilic substituted nucleotide analog 5' and/or 3' of a YGZ motif. The compound of the E class formula may be, for example, any of the following lipophilic substituted nucleotide analogs: a substituted pyrimidine, a substituted uracil, a hydrophobic T analog, a substituted toluene, a substituted imidazole or pyrazole, a substituted triazole, 5-chloro-uracil, 5-bromo-uracil, 5-iodo-uracil, 5-ethyl-uracil, 5-propyl-uracil, 5-propinyl-uracil, (E)-5-(2-bromovinyl)-uracil, or 2.4-difluoro-toluene. E class oligonucleotides are described at least in provisional patent application U.S. 60/847,811.

In some embodiments, immunostimulatory oligonucleotides utilized in accordance with the present invention are T class immunomodulatory oligonucleotides. The "T class" oligonucleotides induce secretion of lower levels of IFN-alpha when not modified as in the ODNs of the invention and IFN-related cytokines and chemokines than B class or C class oligonucleotides, while retaining the ability to induce levels of IL-10 similar to B class oligonucleotides. T class oligonucleotides are described at least in U.S. patent application Ser. No. 11/099,683, the entire contents of which are hereby incorporated by reference.

In some embodiments, immunostimulatory oligonucleotides utilized in accordance with the present invention are P class immunomodulatory oligonucleotides. The "P class" immunostimulatory oligonucleotides have several domains, including a 5TLR activation domain, 2 duplex forming regions and an optional spacer and 3' tail. This class of oligonucleotides has the ability in some instances to induce much higher levels of IFN-α secretion than the C-Class. The P-Class oligonucleotides have the ability to spontaneously self-assemble into concatamers either in vitro and/or in vivo. Without being bound by any particular theory for the method of action of these molecules, one potential hypothesis is that this property endows the P-Class oligonucleotides with the ability to more highly crosslink TLR9 inside certain immune cells, inducing a distinct pattern of immune activation compared to the previously described classes of CpG oligonucleotides. Cross-linking of TLR9 receptors may induce activation of stronger IFN-α secretion through the type I IFNR feedback loop in plasmacytoid dendritic cells. P class oligonucleotides are described at least in U.S. application Ser. No. 11/706,561.

In some embodiments, immunostimulatory oligonucleotides utilized in accordance with the present invention are S class immunomodulatory oligonucleotides. The immunomodulatory oligonucleotides of the instant invention may be immunosuppressive oligonucleotides. The immunomodulatory motifs described above can be used in the context of previously described classes of immunosuppressive oligonucleotides including ODN classes such as the "S class". Inhibitory, or S class, ODN are useful whenever it is desirable to inhibit immunostimulation. Inhibitory ODN can be used for preventing and treating septic shock, inflammation, allergy, asthma, graft rejection, graft-versus host disease (GvHD), autoimmune diseases, Th1- or Th2-mediated diseases, bacterial infections, parasitic infections, spontaneous abortions, and tumors. The inhibitory ODN can be used generally to inhibit activation of all cells expressing the relevant TLRs, and more specifically to inhibit activation of antigen-presenting cells, B cells, plasmacytoid dendritic cells (pDCs), monocytes, monocyte-derived cells, eosinophils, and neutrophils. S class ODN are further described at least in U.S. application Ser. No. 10/977,560.

According to the invention, immunomodulatory oligonucleotides may have a backbone of stabilized internucleotide linkages in addition to the stabilizing FANA purine nucleotide(s) or have a chimeric backbone of stabilized and phosphodiester nucleotide linkages. A "stabilized internucleotide linkage" shall mean an internucleotide linkage that is relatively resistant to in vivo degradation (e.g., via an exo- or endo-nuclease), compared to a phosphodiester internucleotide linkage. In some embodiments, stabilized internucleotide linkages include, without limitation, phosphorothioate, phosphorodithioate, methylphosphonate, methylphosphorothi oate, phosphonoacetate, Rp—phosphorothioate, Sp—phosphorothioate, boranophosphate, or 3'-thioformacetal, or combinations thereof. Other stabilized oligonucleotides include: nonionic DNA analogs, such as alkyl- and aryl-phosphates (in which the charged phosphonate oxygen is replaced by an alkyl or aryl group), phosphodiester and alkylphosphotriesters, in which the charged oxygen moiety is alkylated. Oligonucleotides which contain diol, such as tetraethyleneglycol or hexaethyleneglycol, at either or both termini have also been shown to be substantially resistant to nuclease degradation.

As described in more detained herein, according to the invention, these and other modifications can be selectively introduced at a predetermined position(s)/pattern(s) within an oligonucleotide so as to obtain a stereospecific oligonucleotide molecule. Furthermore, according to the invention, a composition comprising a plurality of such oligonucleotides at an extremely high degree of purity (e.g., at least 96%, at least 97%, at least 98%, at least 99%, essentially 100%) can be obtained. Thus, provided oligonucleotide compositions comprising oligonucleotides of one or more predetermined types are suitable for in vivo administration. It is contemplated that, due to high degree of structural purity of oligonucleotides in a composition (such that a composition comprises a single specified type of oligonucleotides), provided compositions can elicit improved biological activities, increased efficacy, reduced variables in response, and/or reduced unwanted side effects, when administered to subjects.

Accordingly, utilized oligonucleotides of the invention are particularly useful as an therapeutic agent when formulated into a pharmaceutical composition. In some embodiments, such therapeutic agent is an immunomodulatory agent. In some embodiments, provided immunomodualtory agents are immunostimulatory agents. In some embodiments, provided immunomodulatory agents are immunoinhibitory (or immunosuppressive) agents. In some embodiments, provided immunomodulatory agents act as an adjuvant. In some embodiments, provided immunomodulatory agents can shift a Th2 type immune response to a Th1 type immune response by inducing Th1 type cytokines that can suppress inflammatory Th2 response. In some embodiments, provided oligonucleotide compositions are useful as an agent that regulates gene expression. For example, in some embodiments, provided oligonucleotide compositions are useful as an agent capable of silencing a gene of interest, e.g., genes associated with disease or disorder. In some embodiments, provided oligonucleotide compositions are useful as an agent to regulate RNA splicing.

For example, some embodiments of such oligonucleotides include those comprising at least one CpG dinucleotide motif. In some embodiments, such oligonucleotides comprise at least one unmethylated CpG dinucleotide motif. In some embodiments, CpG-containing oligonucleotides useful for the present invention are categorized as Class A (type D) oligonucleotides. In some embodiments, CpG-containing oligonucleotides useful for the present invention are categorized as Class B (type K) oligonucleotides. In some embodiments, CpG-containing oligonucleotides useful for the present invention are categorized as Class C oligonucleotides. In some embodiments, CpG-containing oligonucleotides useful for the present invention are categorized as Class P oligonucleotides. In some embodiments, CpG-containing oligonucleotides useful for the present invention contain at least one palindromic sequence. In some embodiments, CpG-containing oligonucleotides useful for the present invention can form a "dumbbell-like" structure. In some embodiments, CpG-containing oligonucleotides useful for the present invention can form a "Y" shaped structure, or multimers thereof. In some embodiments, CpG-containing oligonucleotides useful for the present invention can form a tetrahedral structure. For reviews, see, for example: Bode et al. (2011) Expert Rev. Vaccines 10(4): 499-511; Hanagata (2012) Int. J. Nanomedicine 7:2181-95.

In some embodiments, oligonucleotides utilized in accordance with the present invention elicit immunomodulatory effects on cells expressing Toll-like receptor(s). In some embodiments, target cells that respond to such oligonucleotides include, but are not limited to, antigen-presenting cells (APCs), antigen-specific T and B cells, cytotoxic T lymphocytes (CTLs), natural killer (NK) cells, and dendritic cells (DCs). In some embodiments, immunomodulatory effects are the direct effects elicited by cells expressing a receptor or receptors that recognize such an oligonucleotide. In some embodiments, such oligonucleotides elicit immunomodulatory effects on cells expressing Toll-like receptor 9 (TLR9) as ligands. For example, some embodiments of the invention include CpG oligonucleotides that act as agonists of one or more Toll-like receptors. Some embodiments of the invention include CpG oligonucleotides that act as antagonists of one or more Toll-like receptors. In some embodiments, immunomodulatory effects are indirect effects that occur downstream, involving cells that do not necessarily respond directly to such oligonucleotides or express such receptors.

In some embodiments, CpG oligonucleotides useful for the present invention are characterized in that they directly activate human B cells and plasmacytoid dendritic cells via TLR-9. In some embodiments, CpG oligodeoxynucleotides useful for the present invention are characterized in that indirectly support the maturation and proliferation of natural killer cells, T cells and monocytes/macrophages.

In some embodiments, CpG oligonucleotides useful for the present invention trigger an immune response, which is characterized by the production of Th1-type and proinflammatory cytokines, chemokines and polyreactive IgM.

In some embodiments, CpG oligonucleotides useful for the present invention are characterized in that the immunogenicity of conventional protein antigens and peptide-based vaccines is enhanced by such oligonucleotides. Without wising to be bound by a particular theory, it is believed that such adjuvant effect is mediated through improved function of professional antigen-presenting cells and the resultant generation of humoral and cellular vaccine-specific immune responses.

In some embodiments, CpG oligonucleotides useful for the present invention are characterized in that CpG oligonucleotides increase the magnitude and accelerate the development of vaccine induced responses. They also improve the induction of memory, thereby extending the duration of humoral and cellular immunity.

In some embodiments, CpG oligonucleotides useful for the present invention are characterized in that they boost immunity in groups of subjects (e.g., populations of patients) with reduced immune function, such as the elderly and those with suppressed immune system. They are effective when administered either systemically or mucosally. Preclinical and clinical trials using CpG oligonucleotides of mixed chirality (e.g., not chirally pure) demonstrate CpG oligonucleotides can boost the immunogenicity of vaccines targeting infectious diseases and cancer. Furthermore, clinical trials indicate that CpG oligonucleotides are reasonably safe when administered s vaccine adjuvants.

Immunomodulatory oligonucleotides prepared in accordance with the present disclosure are useful for a number of therapeutic applications. Therefore, utilized immunomodulatory oligonucleotides may be formulated into suitable pharmaceutical compositions. Such pharmaceutical compositions can be administered to a subject in an amount effective to treat a disease, disorder or condition, as described in further detail herein by suitable routes of administration. According to the invention, an effective amount of an immunostimulatory oligonucleotides may be administered to a subject who is likely to benefit from boosting the immune system (e.g., enhanced immune response). In some embodiments, clinical benefits are conferred directly by an immunomodulatory oligonucleotide acting upon its target immune cells, e.g., via binding of the ligand to its Toll-like receptor proteins. In some embodiments, clinical benefits are achieved at least in part indirectly by overall boosting of the immune system of the subject.

As used herein, the terms "effective amount" and "effective dose" refer to any amount or dose of a compound or composition that is sufficient to fulfill its intended purpose (s), i.e., a desired biological or medicinal response in a tissue or subject at an acceptable benefit/risk ratio. The relevant intended purpose may be objective (i.e., measurable by some test or marker) or subjective (i.e., subject gives an indication of or feels an effect). In some embodiments, a therapeutically effective amount is an amount that, when administered to a population of subjects that meet certain clinical criteria for a disease or disorder (for example, as determined by symptoms manifested, disease progression/stage, genetic profile, etc.), a statistically significant therapeutic response is obtained among the population. A therapeutically effective amount is commonly administered in a dosing regimen that may comprise multiple unit doses. For any particular pharmaceutical agent, a therapeutically effective amount (and/or an appropriate unit dose within an effective dosing regimen) may vary, for example, depending on route of administration, on combination with other pharmaceutical agents. In some embodiments, the specific therapeutically effective amount (and/or unit dose) for any particular patient may depend upon a variety of factors including the disorder being treated and the severity of the disorder; the activity of the specific pharmaceutical agent employed; the specific composition employed; the age, body weight, general health, sex and diet of the patient; the time of administration, route of administration, and/or rate of excretion or metabolism of the specific pharmaceutical agent employed; the duration of the treatment; and like factors as is well known in the medical arts. Those of ordinary skill in the art will appreciate that in some embodiments of the invention, a unit dosage may be considered to contain an effective amount if it contains an amount appropriate for administration in the context of a dosage regimen correlated with a positive outcome. In some embodiments, CpG oligodeoxynucleotides prepared according to the present invention therefore may exert improved efficacy and immunomodulatory effects due to their chiral purity. In some embodiments, an effective amount of provided immunomodulatory oligonucleotides is less than that of less-pure counterpart.

In some embodiments, an immunomodulatory oligonucleotide composition is administered to a healthy subject. In some embodiments, an immunostimulatory oligonucleotide composition is administered to a subject as part of a vaccine, in which the immunostimulatory oligonucleotide acts as an adjuvant. In some embodiments, an immunostimulatory oligonucleotide composition is administered to a subject with a suppressed (e.g., compromised) immune system. In some embodiments, a subject, whose immune system is suppressed and does not sufficiently respond to a conventional vaccine, responds to a vaccine comprising an immunostimulatory oligonucleotide embraced by the present invention. In some embodiments, a subject who may benefit from such a vaccine has a suppressed immune system associated with an infection, such as viral infection, e.g., HIV, HBV, HCV, etc.

The invention encompasses the use of immunomodulatory oligonucleotides contemplated herein for treatment of a subject having a condition that may be treated by stimulation or suppression of the immune response. Thus, provided immunomodulatory oligonucleotide compositions are useful for the treatment of diseases or conditions, including, without limitation, infection, cancer, allergy, asthma, an inflammatory condition, an autoimmune disease, and any combination thereof.

In some embodiments, provided immunomodulatory oligonucleotide compositions are useful in some aspects of the invention for the treatment of a subject at risk of developing a clinical condition. Non-limiting clinical conditions include allergy, asthma, an infection with an infectious organism, cancer, inflammation, and autoimmune disease. A subject at risk as used herein is a subject who has any risk of exposure to an infection causing pathogen or a cancer or an allergen or a risk of developing cancer. For instance, a subject at risk may be a subject who is planning to travel to an area where a particular type of infectious agent is found, or it may be a subject who through lifestyle or medical procedures is exposed to bodily fluids which may contain infectious organisms or directly to the organism, or even any subject living in an area where an infectious organism or an allergen has been identified. Subjects at risk of developing infection also include general populations to which a medical agency recommends vaccination with a particular infectious organism antigen. If the antigen is an allergen and the subject develops allergic responses to that particular antigen and the subject may be exposed to the antigen, i.e., during pollen season, then that subject is at risk of exposure to the antigen. A subject at risk of developing allergy or asthma includes those subjects that have been identified as having an allergy or asthma but that don't have the active disease during the immunomodulatory oligonucleotide treatment as well as subjects that are considered to be at risk of developing these diseases because of genetic or environmental factors. A subject at risk of developing a cancer is one who has a high probability of developing cancer. These subjects include, for instance, subjects having a genetic abnormality, the presence of which has been demonstrated to have a correlative relation to a higher likelihood of developing a cancer and subjects exposed to cancer causing agents such as tobacco, asbestos, or other chemical toxins, or a subject who has previously been treated for cancer and is in apparent remission. When a subject at risk of developing a cancer is treated with an antigen specific for the type of cancer to which the subject is at risk of developing and a CpG immunostimulatory oligonucleotide, the subject may be able to kill the cancer cells as they develop. If a tumor begins to form in the subject, the subject will develop a specific immune response against the tumor antigen.

In some embodiments, provided immunomodulatory oligonucleotide compositions are useful for treating a subject having an immune disease or disorder, including asthma, allergy, and related conditions.

A subject having an allergy is a subject that has or is at risk of developing an allergic reaction in response to an allergen. An allergy refers to acquired hypersensitivity to a substance (allergen). Allergic conditions include but are not limited to eczema, allergic rhinitis or coryza, hay fever, conjunctivitis, bronchial asthma, urticaria (hives) and food allergies, and other atopic conditions.

Allergies are generally caused by IgE antibody generation against harmless allergens. The cytokines that are induced by systemic or mucosal administration of immunomodulatory oligonucleotides are predominantly of a class called Th1 (examples are IL-12, IP-10, IFN-α and IFN-γ) and these induce both humoral and cellular immune responses. The other major type of immune response, which is associated with the production of IL-4 and IL-5 cytokines, is termed a Th2 immune response. In general, it appears that allergic diseases are mediated by Th2 type immune responses. Based on the ability of the immunomodulatory oligonucleotide to shift the immune response in a subject from a predominant Th2 (which is associated with production of IgE antibodies and allergy) to a balanced Th2/Th1 response (which is protective against allergic reactions), an effective dose for inducing an immune response of a immunomodulatory oligonucleotide can be administered to a subject to treat or prevent asthma and allergy.

Thus, provided immunomodulatory oligonucleotide compositions have significant therapeutic utility in the treatment of allergic and non-allergic conditions such as asthma. Th2 cytokines, especially IL-4 and IL-5 are elevated in the airways of asthmatic subjects. These cytokines promote important aspects of the asthmatic inflammatory response, including IgE isotype switching, eosinophil chemotaxis and activation and mast cell growth. Th1 cytokines, especially IFN-γ and IL-12, can suppress the formation of Th2 clones and production of Th2 cytokines. Asthma refers to a disorder of the respiratory system characterized by inflammation, narrowing of the airways and increased reactivity of the airways to inhaled agents. Asthma is frequently, although not exclusively associated with atopic or allergic symptoms.

Provided immunomodulatory oligonucleotide compositions may also be administered in conjunction with an anti-allergy therapy. Conventional methods for treating or preventing allergy have involved the use of allergy medicaments or desensitization therapies. Some evolving therapies for treating or preventing allergy include the use of neutralizing anti-IgE antibodies. Anti-histamines and other drugs which block the effects of chemical mediators of the allergic reaction help to regulate the severity of the allergic symptoms but do not prevent the allergic reaction and have no effect on subsequent allergic responses. Desensitization therapies are performed by giving small doses of an allergen, usually by injection under the skin, in order to induce an IgG-type response against the allergen. The presence of IgG antibody helps to neutralize the production of mediators resulting from the induction of IgE antibodies, it is believed. Initially, the subject is treated with a very low dose of the allergen to avoid inducing a severe reaction and the dose is slowly increased. This type of therapy is dangerous because the subject is actually administered the compounds which cause the allergic response and severe allergic reactions can result.

Anti-allergy medicaments include, but are not limited to, anti-histamines, corticosteroids, and prostaglandin inducers. Anti-histamines are compounds which counteract histamine released by mast cells or basophils. These compounds are well known in the art and commonly used for the treatment of allergy. Anti-histamines include, but are not limited to, acrivastine, astemizole, azatadine, azelastine, betatastine, brompheniramine, buclizine, cetirizine, cetirizine analogues, chlorpheniramine, clemastine, CS 560, cyproheptadine, desloratadine, dexchlorpheniramine, ebastine, epinastine, fexofenadine, HSR 609, hydroxyzine, levocabastine, loratidine, methscopolamine, mizolastine, norastemizole, phenindamine, promethazine, pyrilamine, terfenadine, and tranilast. Corticosteroids include, but are not limited to, methylprednisolone, prednisolone, prednisone, beclomethasone, budesonide, dexamethasone, flunisolide, fluticasone propionate, and triamcinolone. Although dexamethasone is a corticosteroid having antiinflammatory action, it is not regularly used for the treatment of allergy or asthma in an inhaled form because it is highly absorbed and it has long-term suppressive side effects at an effective dose. Dexamethasone, however, can be used according to the invention for treating allergy or asthma because when administered in combination with a composition of the invention it can be administered at a low dose to reduce the side effects. Some of the side effects associated with corticosteroid use include cough, dysphonia, oral thrush (candidiasis), and in higher doses, systemic effects, such as adrenal suppression, glucose intolerance, osteoporosis, aseptic necrosis of bone, cataract formation, growth suppression, hypertension, muscle weakness, skin thinning, and easy bruising. Barnes & Peterson (1993) Am Rev Respir Dis 148:S1-S26; and Kamada A K et al. (1996) Am J Respir Crit Care Med 153:1739-48.

Provided oligonucleotide compositions and methods in accordance with the invention can be used alone or in conjunction with other agents and methods useful for the treatment of asthma. In one aspect the invention provides a method of treating a subject having asthma. The method according to this aspect of the invention includes the step of administering to a subject having asthma an effective amount of a composition of the invention to treat the subject.

In some embodiments, the invention provides a method of treating a subject having asthma. The method according to this aspect of the invention includes the step of administering to a subject having asthma an effective amount of the composition of the invention and an anti-asthma therapy to treat the subject.

"Asthma" as used herein refers to a disorder of the respiratory system characterized by inflammation and narrowing of the airways, and increased reactivity of the airways to inhaled agents. Asthma is frequently, although not exclusively, associated with an atopic or allergic condition. Symptoms of asthma include recurrent episodes of wheezing, breathlessness, chest tightness, and coughing, resulting from airflow obstruction. Airway inflammation associated with asthma can be detected through observation of a number of physiological changes, such as, denudation of airway epithelium, collagen deposition beneath basement membrane, edema, mast cell activation, inflammatory cell infiltration, including neutrophils, eosinophils, and lymphocytes. As a result of the airway inflammation, asthma patients often experience airway hyper-responsiveness, airflow limitation, respiratory symptoms, and disease chronicity. Airflow limitations include acute bronchoconstriction, airway edema, mucous plug formation, and airway remodeling, features which often lead to bronchial obstruction. In some cases of asthma, sub-basement membrane fibrosis may occur, leading to persistent abnormalities in lung function.

Research over the past several years has revealed that asthma likely results from complex interactions among inflammatory cells, mediators, and other cells and tissues resident in the airways. Mast cells, eosinophils, epithelial cells, macrophage, and activated T cells all play an important role in the inflammatory process associated with asthma. Djukanovic R et al. (1990) Am Rev Respir Dis 142:434-457. It is believed that these cells can influence airway function through secretion of preformed and newly synthesized mediators which can act directly or indirectly on the local tissue. It has also been recognized that subpopulations of T lymphocytes (Th2) play an important role in regulating allergic inflammation in the airway by releasing selective cytokines and establishing disease chronicity. Robinson D S et al. (1992) N Engl J Med 326:298-304.

Asthma is a complex disorder which arises at different stages in development and can be classified based on the degree of symptoms as acute, subacute, or chronic. An acute inflammatory response is associated with an early recruitment of cells into the airway. The subacute inflammatory response involves the recruitment of cells as well as the activation of resident cells causing a more persistent pattern of inflammation. Chronic inflammatory response is characterized by a persistent level of cell damage and an ongoing repair process, which may result in permanent abnormalities in the airway.

A "subject having asthma" is a subject that has a disorder of the respiratory system characterized by inflammation and narrowing of the airways and increased reactivity of the airways to inhaled agents. Factors associated with initiation of asthma include, but are not limited to, allergens, cold temperature, exercise, viral infections, and $SO_2$.

As mentioned above, asthma may be associated with a Th2-type of immune response, which is characterized at least in part by Th2 cytokines IL-4 and IL-5, as well as antibody isotype switching to IgE. Th1 and Th2 immune responses are mutually counter-regulatory, so that skewing of the immune response toward a Th1-type of immune response can prevent or ameliorate a Th2-type of immune response, including allergy. Provided immunomodulatory oligonucleotide compositions of the invention are therefore useful by themselves to treat a subject having asthma because the analogs can skew the immune response toward a Th1-type of immune response.

Provided immunomodulatory oligonucleotide compositions of the invention may also be administered in conjunction with an asthma therapy. Conventional methods for treating or preventing asthma have involved the use of anti-allergy therapies (described above) and a number of other agents, including inhaled agents.

Medications for the treatment of asthma are generally separated into two categories, quick-relief medications and long-term control medications. Asthma patients take the long-term control medications on a daily basis to achieve and maintain control of persistent asthma. Long-term control medications include anti-inflammatory agents such as corticosteroids, chromolyn sodium and nedocromil; long-acting bronchodilators, such as long-acting $\beta_2$-agonists and methylxanthines; and leukotriene modifiers. The quick-relief medications include short-acting $\beta_2$ agonists, anticholinergics, and systemic corticosteroids. There are many side effects associated with each of these drugs and none of the drugs alone or in combination is capable of preventing or completely treating asthma.

Anti-asthma medicaments include, but are not limited to, PDE-4 inhibitors, bronchodilator/beta-2 agonists, K+ channel openers, VLA-4 antagonists, neurokin antagonists, thromboxane A2 (TXA2) synthesis inhibitors, xanthines, arachidonic acid antagonists, 5 lipoxygenase inhibitors, TXA2 receptor antagonists, TXA2 antagonists, inhibitor of 5-lipox activation proteins, and protease inhibitors.

Bronchodilator/$\beta_2$ agonists are a class of compounds which cause bronchodilation or smooth muscle relaxation. Bronchodilator/$\beta_2$ agonists include, but are not limited to, salmeterol, salbutamol, albuterol, terbutaline, D2522/formoterol, fenoterol, bitolterol, pirbuerol methylxanthines and orciprenaline. Long-acting $\beta_2$ agonists and bronchodilators are compounds which are used for long-term prevention of symptoms in addition to the anti-inflammatory therapies. Long-acting $\beta_2$ agonists include, but are not limited to, salmeterol and albuterol. These compounds are usually used in combination with corticosteroids and generally are not used without any inflammatory therapy. They have been associated with side effects such as tachycardia, skeletal muscle tremor, hypokalemia, and prolongation of QTc interval in overdose.

Methylxanthines, including for instance theophylline, have been used for long-term control and prevention of symptoms. These compounds cause bronchodilation resulting from phosphodiesterase inhibition and likely adenosine antagonism. Dose-related acute toxicities are a particular problem with these types of compounds. As a result, routine serum concentration must be monitored in order to account for the toxicity and narrow therapeutic range arising from individual differences in metabolic clearance. Side effects include tachycardia, tachyarrhythmias, nausea and vomiting, central nervous system stimulation, headache, seizures, hematemesis, hyperglycemia and hypokalemia. Short-acting $\beta_2$ agonists include, but are not limited to, albuterol, bitolterol, pirbuterol, and terbutaline. Some of the adverse effects associated with the administration of short-acting $\beta_2$ agonists include tachycardia, skeletal muscle tremor, hypokalemia, increased lactic acid, headache, and hyperglycemia.

Chromolyn sodium and nedocromil are used as long-term control medications for preventing primarily asthma symptoms arising from exercise or allergic symptoms arising from allergens. These compounds are believed to block early and late reactions to allergens by interfering with chloride channel function. They also stabilize mast cell membranes and inhibit activation and release of mediators from inosineophils and epithelial cells. A four to six week period of administration is generally required to achieve a maximum benefit.

Anticholinergics are generally used for the relief of acute bronchospasm. These compounds are believed to function by competitive inhibition of muscarinic cholinergic receptors. Anticholinergics include, but are not limited to, ipratropium bromide. These compounds reverse only cholinergically-mediated bronchospasm and do not modify any reaction to antigen. Side effects include drying of the mouth and respiratory secretions, increased wheezing in some individuals, and blurred vision if sprayed in the eyes.

In some embodiments, provided immunomodulatory oligonucleotide compositions may also be useful for treating airway remodeling. Airway remodeling results from smooth muscle cell proliferation and/or submucosal thickening in the airways, and ultimately causes narrowing of the airways leading to restricted airflow. The immunomodulatory oligonucleotides of the invention may prevent further remodeling and possibly even reduce tissue build-up resulting from the remodeling process.

In some embodiments, provided immunomodulatory oligonucleotide compositions are useful for treating a subject having an inflammatory disorder. As used herein, the term "inflammatory disorder" refers to a condition associated with an antigen-nonspecific reaction of the innate immune system that involves accumulation and activation of leukocytes and plasma proteins at a site of infection, toxin exposure, or cell injury. Cytokines that are characteristic of inflammation include tumor necrosis factor (TNF-$\alpha$), interleukin 1 (IL-1), IL-6, IL-12, interferon alpha (IFN-$\alpha$), interferon beta (IFN-$\beta$), and chemokines. Thus, certain types of asthma, allergy, and autoimmune disorders may have characteristics of an inflammatory disorder. Inflammatory disorders also include, for example cardiovascular disease, chronic obstructive pulmonary disease (COPD), bronchiectasis, chronic cholecystitis, tuberculosis, Hashimoto's thyroiditis, sepsis, sarcoidosis, silicosis and other pneumoconioses, and an implanted foreign body in a wound, but are not so limited. As used herein, the term "sepsis" refers to a well-recognized clinical syndrome associated with a host's systemic inflammatory response to microbial invasion. The term "sepsis" as used herein refers to a condition that is typically signaled by fever or hypothermia, tachycardia, and tachypnea, and in severe instances can progress to hypotension, organ dysfunction, and even death.

In some embodiments, provided immunomodulatory oligonucleotide compositions are useful for treating a subject having an infection. In some embodiments, provided immunomodulatory oligonucleotide compositions are useful for treating a subject who is susceptible to an infection, including those who may have exposure to a pathogen or pathogens. The immunomodulatory oligonucleotides utilized in accordance with the invention can in some aspects also be used to treat or prevent infections by viruses, bacteria, fungi, or parasites. A subject having an infection is a subject that has been exposed to an infectious pathogen and has acute or chronic detectable levels of the pathogen in the body. The immunomodulatory oligonucleotides can be used with or without an antigen to mount an antigen specific systemic or mucosal immune response that is capable of reducing the level of or eradicating the infectious pathogen. An infectious disease, as used herein, is a disease arising from the presence of a foreign microorganism in the body. It is particularly important to develop effective vaccine strategies and treatments to protect the body's mucosal surfaces, which are the primary site of pathogenic entry.

Viruses are small infectious agents which generally contain a nucleic acid core and a protein coat, but are not independently living organisms. Viruses can also take the form of infectious nucleic acids lacking a protein. A virus cannot survive in the absence of a living cell within which it can replicate. Viruses enter specific living cells either by endocytosis or direct injection of DNA (phage) and multiply, causing disease. The multiplied virus can then be released and infect additional cells. Some viruses are DNA-containing viruses and others are RNA-containing viruses. DNA viruses include Pox, Herpes, Adeno, Papova, Parvo, and Hepadna. RNA viruses include Picorna, Calici, Astro.Toga, Flavi, Corona, Paramyxo, Orthomyxo, Bunya, Arena, Rhabdo, FiIo, Borna, Reo, and Retro. In some aspects, the invention also intends to treat diseases in which prions are implicated in disease progression such as for example bovine spongiform encephalopathy (i.e., mad cow disease, BSE) or scrapie infection in animals, or Creutzfeldt-Jakob disease in humans.

Viruses include, but are not limited to, enteroviruses (including, but not limited to, viruses that the family picornaviridae, such as polio virus, Coxsackie virus, echo virus), rotaviruses, adenovirus, and hepatitis virus, such as hepatitis A, B, C D and E. Specific examples of viruses that have been found in humans include but are not limited to: Retroviridae (e.g., human immunodeficiency viruses, such as HIV-1 (also referred to as HTLV-III, LAV or HTLV-III/LAV, or HIV-III; and other isolates, such as HIV-LP; Picornaviridae (e.g., polio viruses, hepatitis A virus; enteroviruses, human Coxsackie viruses, rhinoviruses, echoviruses); Calciviridae (e.g., strains that cause gastroenteritis); Togaviridae (e.g., equine encephalitis viruses, rubella viruses); Flaviviridae (e.g., dengue viruses, encephalitis viruses, yellow fever viruses); Coronaviridae (e.g., coronavi ruses); Rhabdoviridae (e.g., vesicular stomatitis viruses, rabies viruses); Filoviridae (e.g., ebola viruses); Paramyxoviridae (e.g., parainfluenza viruses, mumps virus, measles virus, respiratory syncytial virus); Orthomyxoviridae (e.g., influenza viruses); Bunyaviridae (e.g., Hantaan viruses, bunya viruses, phleboviruses and Nairo viruses); Arenaviridae (hemorrhagic fever viruses); Reoviridae (e.g., reoviruses, orbiviurses and rotaviruses); Birnaviridae; Hepadnaviridae (Hepatitis B virus); Parvoviridae (parvoviruses); Papovavihdae (papillomaviruses, polyoma viruses); Adenoviridae (most adenoviruses); Herpesviridae (herpes simplex virus (HSV) 1 and 2, varicella zoster virus, cytomegalovirus (CMV)); Poxviridae (variola viruses, vaccinia viruses, pox viruses); Iridoviridae (e.g., African swine fever virus); and other viruses acute laryngotracheobronchitis virus, Alphavirus, Kaposi's sarcoma-associated herpesvirus, Newcastle disease virus, Nipah virus, Norwalk virus, Papillomavirus, parainfluenza virus, avian influenza, SARs virus, West Nile virus. Viruses that infect plants include, for example, viruses of the genera and/or families of Alfamoviruses: Bromoviridae, Alphacryptoviruses: Partitiviridae, Badnaviruses, Betacryptoviruses: Partitiviridae, Bigeminiviruses: Geminiviridae, Bromoviruses: Bromoviridae, Bymoviruses: Potyviridae, Capilloviruses, Carlaviruses, Carmoviruses: Tombusviridae, Caulimoviruses, Closteroviruses, Comoviruses: Comoviridae, Cucumoviruses: Bromoviridae, Cytorhabdoviruses: Rhabdoviridae, Dianthoviruses, Enamoviruses, Fabaviruses: Comoviridae, Fijiviruses: Reoviridae, Furoviruses, Hordeiviruses, Hybrigeminiviruses: Geminiviridae, Idaeoviruses, Ilarviruses: Bromoviridae, Ipomoviruses: Potyviridae, Luteoviruses, Machlomoviruses, Macluraviruses, Marafiviruses, Monogeminiviruses: Geminiviridae, Nanaviruses, Necroviruses, Nepoviruses: Comoviridae, Nucleorhabdoviruses: Rhabdoviridae, Oryzaviruses: Reoviridae, Ourmiaviruses, Phytoreoviruses: Reoviridae, Potexviruses, Potyviruses: Potyviridae, Rymoviruses: Potyviridae, Satellite RNAs, Satelliviruses, Sequiviruses: Sequiviridae, Sobemoviruses, Tenuiviruses, Tobamoviruses, Tobraviruses, Tombusviruses: Tombusviridae, Tospoviruses: Bunyaviridae, Trichoviruses, Tymoviruses, Umbraviruses, Unassigned potyviruses: Potyviridae, Unassigned rhabdoviruses: Rhabdoviridae, Varicosaviruses, Waikaviruses: Sequiviridae, Ungrouped viruses, Bromoviridae Potyviridae and Tymoviridae; particular relevant plant viruses invclude, for example, Tobacco mosaic virus (TMV), Tomato spotted wilt virus, Tomato yellow leaf curl virus, Cucumber mosaic virus, Potato virus Y, Cauliflower mosaic virus, African cassava mosaic virus, Plum pox virus, Brome mosaic virus, Potato virus X, Citrus tristeza virus, Barley yellow dwarf virus, Potato leafroll virus and Tomato bushy stunt virus.

Viral hepatitis is an inflammation of the liver which may produce swelling, tenderness, and sometimes permanent damage to the liver. If the inflammation of the liver continues at least six months or longer, it is referred to as chronic hepatitis. There are at least five different viruses known to cause viral hepatitis, include hepatitis $A_1$ B, C D and E. Hepatitis A is generally communicated through food or drinking water contaminated with human feces. Hepatitis B generally is spread through bodily fluids such as blood. For instance, it may be spread from mother to child at birth, through sexual contact, contaminated blood transfusions and needles. Hepatitis C is quite common and like Hepatitis B is often spread through blood transfusions and contaminated needles. Hepatitis D is found most often in IV drug users who are carriers of the hepatitis B virus with which it co-associates. Hepatitis E is similar to viral hepatitis A and is generally associated with poor sanitation.

Both gram negative and gram positive bacteria serve as antigens in vertebrate animals. Such gram positive bacteria include, but are not limited to, *Pasteurella* species, Staphylococci species, and *Streptococcus* species. Gram negative bacteria include, but are not limited to, *Escherichia coli, Pseudomonas* species, and Salmonella species. Specific examples of infectious bacteria include but are not limited to, *Helicobacter pyloris, Borelia burgdorferi, Legionella pneumophilia, Mycobacteria* sps (e.g. *M. tuberculosis, M. avium, M. intracellular, M. kansaii, M. gordonae), Staphylococcus aureus, Neisseria gonorrhoeae, Neisseria meningitidis, Listeria monocytogenes, Streptococcus pyogenes* (Group A *Streptococcus), Streptococcus agalactiae* (Group B *Streptococcus), Streptococcus* (viridans group), *Streptococcus faecalis, Streptococcus bovis, Streptococcus* (anaerobic sps.), *Streptococcus pneumoniae*, pathogenic *Campylobacter* sp., *Enterococcus* sp., *Haemophilus influenzae, Bacillus antracis, corynebacterium diphtheriae, corynebacterium sp., Erysipelothrix rhusiopathiae, Clostridium* pen ringers, *Clostridium tetani, Enterobacter aerogenes, Klebsiella pneumoniae, Pasteurella multocida, Bacteroides* sp., *Fusobacterium nucleatum, Streptobacillus moniliformis,*

*Treponema pallidium, Treponema pertenue, Leptospira, Rickettsia,* and *Actinomyces israelii.*

Examples of fungi include *Cryptococcus neoformans, Histoplasma capsulatum, Coccidioides immitis, Blastomyces dermatitidis, Chlamydia trachomatis, Candida albicans.*

Other infectious organisms (i.e., protists) include *Plasmodium* spp. such as *Plasmodium falciparum, Plasmodium malariae, Plasmodium ovale,* and *Plasmodium vivax* and *Toxoplasma gondii.* Blood-borne and/or tissues parasites include *Plasmodium* spp., *Babesia microti, Babesia divergens, Leishmania tropica, Leishmania* spp., *Leishmania braziliensis, Leishmania donovani, Trypanosoma gambiense* and *Trypanosoma rhodesiense* (African sleeping sickness), *Trypanosoma cruzi* (Chagas' disease), and *Toxoplasma gondii.*

Other medically relevant microorganisms have been described extensively in the literature, e.g., see C. G. A Thomas, Medical Microbiology, Bailliere Tindall, Great Britain 1983, the entire contents of which is hereby incorporated by reference. Agriculturally relevant microorganisms (e.g., those that infect crops and/or livestock) are also known, for example but not limited to those described in, e.g., George N. Agrios, Plant Pathology, Elsevier Academic Press, $5^h$ Edition, 2005; John Lucas, Plant Pathology and Plant Pathogens, Wiley-Blackwell; $3^{rd}$ edition, 1998; Dwight C. Hirsh, N. James MacLachlan, Richard L. Walker, Veterinary Microbiology, Wiley-Blackwell; 2 edition, 2004; and P. J. Quinn, et al, Veterinary Microbiology and Microbial Disease, Wiley-Blackwell; 2 edition, 2011.

Provided oligonucleotide compositions of the invention may be administered to a subject (including, for example, a human subject or, in some embodiments an animal [e.g., livestock or pet animal] or plant [e.g., crop] subject) with an anti-microbial agent. An anti-microbial agent, as used herein, refers to a naturally-occurring or synthetic compound which is capable of killing or inhibiting infectious microorganisms. The type of anti-microbial agent useful according to the invention will depend upon the type of microorganism with which the subject is infected or at risk of becoming infected. Anti-microbial agents include but are not limited to anti-bacterial agents, anti-viral agents, anti-fungal agents and anti-parasitic agents. Phrases such as "anti-infective agent", "anti-bacterial agent", "anti-viral agent", "anti-fungal agent", "antiparasitic agent" and "parasiticide" have well-established meanings to those of ordinary skill in the art and are defined in standard medical texts. Briefly, anti-bacterial agents kill or inhibit bacteria, and include antibiotics as well as other synthetic or natural compounds having similar functions. Antibiotics are low molecular weight molecules which are produced as secondary metabolites by cells, such as microorganisms. In general, antibiotics interfere with one or more bacterial functions or structures which are specific for the microorganism and which are not present in host cells. Anti-viral agents can be isolated from natural sources or synthesized and are useful for killing or inhibiting viruses. Anti-fungal agents are used to treat superficial fungal infections as well as opportunistic and primary systemic fungal infections. Anti-parasite agents kill or inhibit parasites.

Examples of anti-parasitic agents, also referred to as parasiticides useful for human administration include but are not limited to albendazole, amphotericin B, benznidazole, bithionol, chloroquine HCl, chloroquine phosphate, clindamycin, dehydroemetine, di ethylcarbamazine, diloxanide furoate, eflornithine, furazolidaone, glucocorticoids, halofantrine, iodoquinol, ivermectin, mebendazole, mefloquine, meglumine antimoniate, melarsoprol, metrifonate, metronidazole, niclosamide, nifurtimox, oxamniquine, paromomycin, pentamidine isethionate, piperazine, praziquantel, primaquine phosphate, proguanil, pyrantel pamoate, pyrimethanmine-sulfonamides, pyrimethanmine-sulfadoxine, quinacrine HCl, quinine sulfate, quinidine gluconate, spiramycin, stibogluconate sodium (sodium antimony gluconate), suramin, tetracycline, doxycycline, thiabendazole, tinidazole, trimethroprim-sulfamethoxazole, and trypars-amide some of which are used alone or in combination with others.

Antibacterial agents kill or inhibit the growth or function of bacteria. A large class of antibacterial agents is antibiotics. Antibiotics, which are effective for killing or inhibiting a wide range of bacteria, are referred to as broad spectrum antibiotics. Other types of antibiotics are predominantly effective against the bacteria of the class gram-positive or gram-negative. These types of antibiotics are referred to as narrow spectrum antibiotics. Other antibiotics which are effective against a single organism or disease and not against other types of bacteria, are referred to as limited spectrum antibiotics. Antibacterial agents are sometimes classified based on their primary mode of action. In general, antibacterial agents are cell wall synthesis inhibitors, cell membrane inhibitors, protein synthesis inhibitors, nucleic acid synthesis or functional inhibitors, and competitive inhibitors.

Antiviral agents are compounds which prevent infection of cells by viruses or replication of the virus within the cell. There are many fewer antiviral drugs than antibacterial drugs because the process of viral replication is so closely related to DNA replication within the host cell, that non-specific antiviral agents would often be toxic to the host. There are several stages within the process of viral infection which can be blocked or inhibited by antiviral agents. These stages include, attachment of the virus to the host cell (immunoglobulin or binding peptides), uncoating of the virus (e.g. amantadine), synthesis or translation of viral mRNA (e.g. interferon), replication of viral RNA or DNA (e.g. nucleotide analogues), maturation of new virus proteins (e.g. protease inhibitors), and budding and release of the virus.

Nucleotide analogues are synthetic compounds which are similar to nucleotides, but which have an incomplete or abnormal deoxyribose or ribose group. Once the nucleotide analogues are in the cell, they are phosphorylated, producing the triphosphate formed which competes with normal nucleotides for incorporation into the viral DNA or RNA. Once the triphosphate form of the nucleotide analogue is incorporated into the growing nucleic acid chain, it causes irreversible association with the viral polymerase and thus chain termination. Nucleotide analogues include, but are not limited to, acyclovir (used for the treatment of herpes simplex virus and varicella-zoster virus), gancyclovir (useful for the treatment of cytomegalovirus), idoxuridine, ribavirin (useful for the treatment of respiratory syncitial virus), dideoxyinosine, dideoxycytidine, zidovudine (azidothymidine), imiquimod, and resimiquimod.

The interferons are cytokines which are secreted by virus-infected cells as well as immune cells. The interferons function by binding to specific receptors on cells adjacent to the infected cells, causing the change in the cell which protects it from infection by the virus, $\alpha$ and $\beta$-interferon also induce the expression of Class I and Class II MHC molecules on the surface of infected cells, resulting in increased antigen presentation for host immune cell recognition, $\alpha$ and $\beta$-interferons are available as recombinant forms and have been used for the treatment of chronic hepatitis B and C infection. At the dosages which are effective for anti-viral therapy, interferons have severe side effects such as fever, malaise and weight loss.

Anti-viral agents useful in the invention include but are not limited to immunoglobulins, amantadine, interferons, nucleotide analogues, and protease inhibitors. Specific examples of anti-virals include but are not limited to Acemannan; Acyclovir; Acyclovir Sodium; Adefovir; Alovudine; Alvircept Sudotox; Amantadine Hydrochloride; Aranotin; Arildone; Atevirdine Mesylate; Avridine; Cidofovir; Cipamfylline; Cytarabine Hydrochloride; Delavirdine Mesylate; Desciclovir; Didanosine; Disoxaril; Edoxudine; Enviradene; Enviroxime; Famciclovir; Famotine Hydrochloride; Fiacitabine; Fialuridine; Fosarilate; Foscarnet Sodium; Fosfonet Sodium; Ganciclovir; Ganciclovir Sodium; Idoxuridine; Kethoxal; Lamivudine; Lobucavir; Memotine Hydrochloride; Methisazone; Nevirapine; Penciclovir; Pirodavir; Ribavirin; Rimantadine Hydrochloride; Saquinavir Mesylate; Somantadine Hydrochloride; Sorivudine; Statolon; Stavudine; Tilorone Hydrochloride; Trifluridine; Valacyclovir Hydrochloride; Vidarabine; Vidarabine Phosphate; Vidarabine Sodium Phosphate; Viroxime; Zalcitabine; Zidovudine; and Zinviroxime.

Anti-fungal agents are useful for the treatment and prevention of infective fungi. Anti-fungal agents are sometimes classified by their mechanism of action. Some antifungal agents function as cell wall inhibitors by inhibiting glucose synthase. These include, but are not limited to, basiungin/ECB. Other anti-fungal agents function by destabilizing membrane integrity. These include, but are not limited to, immidazoles, such as clotrimazole, sertaconzole, fluconazole, itraconazole, ketoconazole, miconazole, and voriconacole, as well as FK 463, amphotericin B, BAY 38-9502, MK 991, pradimicin, UK 292, butenafine, and terbinafine. Other anti-fungal agents function by breaking down chitin (e.g. chitinase) or immunosuppression (501 cream).

In some embodiments, provided immunomodulatory oligonucleotide compositions are useful for treating a subject having a cell proliferative disease, such as cancer. A subject having a cancer is a subject that has detectable cancerous cells. The cancer may be a malignant or non-malignant cancer. Cancers or tumors include but are not limited to biliary tract cancer; brain cancer; breast cancer; cervical cancer; choriocarcinoma; colon cancer; endometrial cancer; esophageal cancer; gastric cancer; intraepithelial neoplasms; lymphomas; liver cancer; lung cancer (e.g. small cell and non-small cell); melanoma; neuroblastomas; oral cancer; ovarian cancer; pancreas cancer; prostate cancer; rectal cancer; sarcomas; skin cancer; testicular cancer; thyroid cancer; and renal cancer, as well as other carcinomas and sarcomas. In one embodiment the cancer is hairy cell leukemia, chronic myelogenous leukemia, cutaneous T-cell leukemia, multiple myeloma, follicular lymphoma, malignant melanoma, squamous cell carcinoma, renal cell carcinoma, prostate carcinoma, bladder cell carcinoma, or colon carcinoma.

Provided immunomodulatory oligonucleotide compositions may be administered alone or in conjunction with an anti-cancer therapy. Anti-cancer therapies include but are not limited to radiation therapy, chemotherapy, immunotherapy, a cancer vaccine, hormone therapy, a biological response modifier, and surgical procedures. A cancer medicament refers to an agent which is administered to a subject for the purpose of treating a cancer. As used herein, "treating cancer" includes preventing the development of a cancer, reducing the symptoms of cancer, and/or inhibiting the growth of an established cancer. In other aspects, the cancer medicament is administered to a subject at risk of developing a cancer for the purpose of reducing the risk of developing the cancer. Various types of medicaments for the treatment of cancer are described herein. For the purpose of this specification, cancer medicaments are classified as chemotherapeutic agents, immunotherapeutic agents, cancer vaccines, hormone therapy, and biological response modifiers.

Additionally, the methods of the invention are intended to embrace the use of more than one cancer medicament along with provided immunomodulatory oligonucleotide compositions. As an example, where appropriate, provided immunomodulatory oligonucleotide compositions may be administered with both a chemotherapeutic agent and an immunotherapeutic agent. Alternatively, the cancer medicament may embrace an immunotherapeutic agent and a cancer vaccine, or a chemotherapeutic agent and a cancer vaccine, or a chemotherapeutic agent, an immunotherapeutic agent and a cancer vaccine all administered to one subject for the purpose of treating a subject having a cancer or at risk of developing a cancer.

Chemotherapeutic agent may be selected from the group consisting of methotrexate, vincristine, adriamycin, cisplatin, non-sugar containing chloroethylnitrosoureas, 5-fluorouracil, mitomycin C, bleomycin, doxorubicin, dacarbazine, taxol, fragyline, Meglamine GLA, valrubicin, carmustaine and poliferposan, MMI270, BAY 12-9566, RAS famesyl transferase inhibitor, famesyl transferase inhibitor, MMP, MTA/LY231514, LY264618/Lometexol, Glamolec, CI-994, TNP-470, Hycamtin/Topotecan, PKC412, Valspodar/PSC833, Novantrone/Mitroxantrone, Metaret/Suramin, Batimastat, E7070, BCH-4556, CS-682, 9-AC, AG3340, AG3433, Incel/VX-710, VX-853, ZD0101, ISI641, ODN 698, TA 2516/Marmistat, BB2516/Marmistat, CDP 845, D2163, PD183805, DX8951f, Lemonal DP 2202, FK 317, Picibanil/OK-432, AD 32/Valrubicin, Metastron/strontium derivative, Temodal/Temozolomide, Evacet/liposomal doxorubicin, Yewtaxan/Paclitaxel, Taxol/Paclitaxel, Xeload/Capecitabine, Furtulon/Doxifluridine, Cyclopax/oral paclitaxel, Oral Taxoid, SPU-077/Cisplatin, HMR 1275/Flavopiridol, CP-358 (774)/EGFR, CP-609 (754)/RAS oncogene inhibitor, BMS-182751/oral platinum, UFT (Tegafur/Uracil), Ergamisol/Levamisole, Eniluracil/776C85/5FU enhancer, Campto/Levamisole, Camptosar/Irinotecan, Tumodex/Ralitrexed, Leustatin/Cladribine, Paxex/Paclitaxel, Doxil/liposomal doxorubicin, Caelyx/liposomal doxorubicin, Fludara/Fludarabine, Pharmarubicin/Epirubicin, DepoCyt, ZD1839, LU 79553/Bis-Naphtalimide, LU 103793/Dolastain, Caetyx/liposomal doxorubicin, Gemzar/Gemcitabine, ZD 0473/Anormed, YM 116, Iodine seeds, CDK4 and CDK2 inhibitors, PARP inhibitors, D4809/Dexifosamide, Ifes/Mesnex/Ifosamide, Vumon/Teniposide, Paraplatin/Carboplatin, Plantinol/cisplatin, Vepeside/Etoposide, ZD 9331, Taxotere/Docetaxel, prodrug of guanine arabinoside, Taxane Analog, nitrosoureas, alkylating agents such as melphelan and cyclophosphamide, Aminoglutethimide, Asparaginase, Busulfan, Carboplatin, Chlorambucil, Cytarabine HCl, Dactinomycin, Daunorubicin HCl, Estramustine phosphate sodium, Etoposide (VP16-213), Floxuridine, Fluorouracil (5-FU), Flutamide, Hydroxyurea (hydroxycarbamide), Ifosfamide, Interferon Alfa-2a, Alfa-2b, Leuprolide acetate (LHRH-releasing factor analogue), Lomustine (CCNU), Mechloretamine HCl (nitrogen mustard), Mercaptopurine, Mesna, Mitotane (o.p'-DDD), Mitoxantrone HCl, Octreotide, Plicamycin, Procarbazine HCl, Streptozocin, Tamoxifen citrate, Thioguanine, Thiotepa, Vinblastine sulfate, Amsacrine (m-AMSA), Azacitidine, Erthropoietin, Hexamethylmelamine (HMM), Interleukin 2, Mitoguazone (methyl-GAG; methyl glyoxal bis-guanylhydrazone; MGBG), Pentostatin (2'deoxycoformycin), Semustine (methyl-CCNU), Teniposide (VM-26) and Vindesine sulfate, but it is not so limited.

Immunotherapeutic agent may be selected from the group consisting of Ributaxin, Herceptin, Quadramet, Panorex, IDEC-Y2B8, BEC2, C225, Oncolym, SMART M195, ATRAGEN, Ovarex, Bexxar, LDP-03, ior tP3, MDX-210, MDX-11, MDX-22, OV103, 3622W94, anti-VEGF, Zenapax, MDX-220, MDX-447, MELIMMUNE-2, MELIMMUNE-1, CEACIDE, Pretarget, NovoMAb-G2, TNT, Gliomab-H, GNI-250, EMD-72000, LymphoCide, CMA 676, Monopharm-C, 4B5, ior egf.r3, ior c5, BABS, anti-FLK-2, MDX-260, ANA Ab, SMART 1 D10 Ab, SMART ABL 364 Ab and ImmuRAIT-CEA, but it is not so limited.

Cancer vaccine may be selected from the group consisting of EGF, Anti-idiotypic cancer vaccines, Gp75 antigen, GMK melanoma vaccine, MGV ganglioside conjugate vaccine, Her2/neu, Ovarex, M-Vax, O-Vax, L-Vax, STn-KHL theratope, BLP25 (MUC-1), liposomal idiotypic vaccine, Melacine, peptide antigen vaccines, toxin/antigen vaccines, MVA-based vaccine, PACIS, BCG vacine, TA-HPV, TA-CIN, DISC-virus and ImmuCyst/TheraCys, but it is not so limited.

As used herein, the terms "cancer antigen" and "tumor antigen" are used interchangeably to refer to antigens which are differentially expressed by cancer cells and can thereby be exploited in order to target cancer cells. Cancer antigens are antigens which can potentially stimulate apparently tumor-specific immune responses. Some of these antigens are encoded, although not necessarily expressed, by normal cells. These antigens can be characterized as those which are normally silent (i.e., not expressed) in normal cells, those that are expressed only at certain stages of differentiation and those that are temporally expressed such as embryonic and fetal antigens. Other cancer antigens are encoded by mutant cellular genes, such as oncogenes (e.g., activated ras oncogene), suppressor genes (e.g., mutant p53), fusion proteins resulting from internal deletions or chromosomal translocations. Still other cancer antigens can be encoded by viral genes such as those carried on RNA and DNA tumor viruses.

In some embodiments, provided immunomodulatory oligonucleotide compositions may also be useful for treating and preventing autoimmune disease. Autoimmune disease is a class of diseases in which a subject's own antibodies react with host tissue or in which immune effector T cells are autoreactive to endogenous self peptides and cause destruction of tissue. Thus an immune response is mounted against a subject's own antigens, referred to as self antigens. Autoimmune diseases include but are not limited to alopecia areata, acquired hemophilia, ankylosing spondylitis, antiphospholipid syndrome, autoimmune-associated infertility, autoimmune encephalomyelitis, autoimmune hepatitis, autoimmune hemolytic anemia, autoimmune diabetes mellitus, autoimmune thrombocytopenic purpura, Behget's syndrome, bullous pemphigoid, cardiomyopathy, chronic fatigue immune dysfunction syndrome (CFDS), chronic inflammatory demyelinating polyneuropathy, Churg-Strauss syndrome, cicatricial pemphigoid, CREST syndrome, cold agglutinin disease, dermatomyositis, discoid lupus, essential mixed cryoglobulinemia, fibromyalgia, fibromyositis, Guillain-Barre syndrome, Hashimoto's thyroiditis, glomerulonephritis (e.g., crescentic glomerulonephritis, proliferative glomerulonephritis), Grave's disease, graft versus host disease, Goodpasture's syndrome, pemphigus (e.g., pemphigus vulgaris), idiopathic pulmonary fibrosis, idiopathic thrombocytopenic purpura, insulin resistance, idiopathic Addison's disease, IgA nephropathy, inflammatory bowel disease (including Crohn's disease and ulcerative colitis), juvenile arthritis, lichen planus, myasthenia gravis, multiple sclerosis, mixed connective tissue disease, polymyositis, pernicious anemia, polyarteritis nodosa, polychondritis, polyglandular syndromes, polymyalgia rheumatica, primary agammaglobulinemia, primary biliary cirrhosis, psoriasis, Raynaud's phenomena, Reiteˆs syndrome, juvenile and adult rheumatoid arthritis, Sjorgen's syndrome, scleroderma with anti-collagen antibodies, sarcoidosis, stiff-man syndrome, systemic lupus erythematosus (SLE), Takayasu arthritis, transplanted organ rejection, temporal arteritis/giant cell arteritis, uveitis, ulcerative colitis, vasculitis, and vitiligo.

A "self-antigen" as used herein refers to an antigen of a normal host tissue. Normal host tissue does not include cancer cells. Thus an immune response mounted against a self-antigen, in the context of an autoimmune disease, is an undesirable immune response and contributes to destruction and damage of normal tissue, whereas an immune response mounted against a cancer antigen is a desirable immune response and contributes to the destruction of the tumor or cancer. Thus, in some aspects of the invention aimed at treating autoimmune disorders it is not recommended that the immunomodulatory oligonucleotides be administered with self antigens, particularly those that are the targets of the autoimmune disorder.

In other instances, immunomodulatory oligonucleotides used in according to the present invention may be delivered with low doses of self-antigens. A number of animal studies have demonstrated that mucosal administration of low doses of antigen can result in a state of immune hyporesponsiveness or "tolerance." The active mechanism appears to be a cytokine-mediated immune deviation away from a Th1 towards a predominantly Th2 and Th3 (i.e., TGF-β dominated) response. The active suppression with low dose antigen delivery can also suppress an unrelated immune response (bystander suppression) which is of considerable interest in the therapy of autoimmune diseases, for example, rheumatoid arthritis and SLE. Bystander suppression involves the secretion of Th1—counter-regulatory, suppressor cytokines in the local environment where proinflammatory and Th1 cytokines are released in either an antigen-specific or antigen-nonspecific manner. 'Tolerance" as used herein is used to refer to this phenomenon. Indeed, oral tolerance has been effective in the treatment of a number of autoimmune diseases in animals including: experimental autoimmune encephalomyelitis (EAE), experimental autoimmune myasthenia gravis, collagen-induced arthritis (CIA), and insulin-dependent diabetes mellitus. In these models, the prevention and suppression of autoimmune disease is associated with a shift in antigen-specific humoral and cellular responses from a Th1 to Th2/Th3 response Non-limiting examples of useful immunomodulatory oligonucleotides that can be utilized in accordance with the present invention are provided in the accompanying Appendix (B).

RIPtides

In some embodiments, oligonucleotides utilized in accordance with the present invention are or act as RNA-interacting polynucleotides ("RIPtides"). RIPtides are a class of therapeutics intended to open up the space of "undruggable" targets by inactivating structural RNAs implicated in disease. RIPtides are typically small nucleotide stretches (around 8 nucleotides) that bind and disrupt the action of structured RNA. Due to their size, these molecules can readily pass through the cell membrane. See, for example, U.S. Pat. No. 6,080,585.

RIPtides may be useful for a number of clinical applications. In the context of cancer therapy, at least one target is telomerase, which is present in about 90% of cancer cells. Therefore, in some embodiments, stereo-defined oligonucleotides of the invention can be used to target telomerase for the treatment of various cancer. In addition, RIPtides may be useful for the treatment of infectious disease. Viruses, such as HIV and Hepatitis C, must be able to take over a host cell in order to replicate; therefore, structural RNA can play an important role in the maturation and replication of many viruses. Accordingly, in some embodiments, stereo-defined oligonucleotides of the invention can be used to target portions of DNA or RNA involved in viral maturation and/or replication.

Thus, the invention is useful for treating various viral infections. Viruses include, but are not limited to, enteroviruses (including, but not limited to, viruses that the family picornaviridae, such as polio virus, Coxsackie virus, echo virus), rotaviruses, adenovirus, and hepatitis virus, such as hepatitis A, B, C D and E. Specific examples of viruses that have been found in humans include but are not limited to: Retroviridae (e.g., human immunodeficiency viruses, such as HIV-1 (also referred to as HTLV-III, LAV or HTLV-III/LAV, or HIV-III; and other isolates, such as HIV-LP; Picornaviridae (e.g., polio viruses, hepatitis A virus; enteroviruses, human Coxsackie viruses, rhinoviruses, echoviruses); Calciviridae (e.g., strains that cause gastroenteritis); Togaviridae (e.g., equine encephalitis viruses, rubella viruses); Flaviviridae (e.g., dengue viruses, encephalitis viruses, yellow fever viruses); Coronaviridae (e.g., coronavi ruses); Rhabdoviridae (e.g., vesicular stomatitis viruses, rabies viruses); Filoviridae (e.g., ebola viruses); Paramyxoviridae (e.g., parainfluenza viruses, mumps virus, measles virus, respiratory syncytial virus); Orthomyxoviridae (e.g., influenza viruses); Bunyaviridae (e.g., Hantaan viruses, bunya viruses, phleboviruses and Nairo viruses); Arenaviridae (hemorrhagic fever viruses); Reoviridae (e.g., reoviruses, orbiviurses and rotaviruses); Birnaviridae; Hepadnaviridae (Hepatitis B virus); Parvoviridae (parvoviruses); Papovavihdae (papillomaviruses, polyoma viruses); Adenoviridae (most adenoviruses); Herpesviridae (herpes simplex virus (HSV) 1 and 2, varicella zoster virus, cytomegalovirus (CMV)); Poxviridae (variola viruses, vaccinia viruses, pox viruses); Iridoviridae (e.g., African swine fever virus); and other viruses acute laryngotracheobronchitis virus, Alphavirus, Kaposi's sarcoma-associated herpesvirus, Newcastle disease virus, Nipah virus, Norwalk virus, Papillomavirus, parainfluenza virus, avian influenza, SARs virus, West Nile virus.

Antisense Drugs

The present invention also encompasses a variety of antisense-based therapeutics. Typically, antisense drugs are small (12-21 nucleotides) DNA- or RNA-like compounds that are chemically modified to engineer favorable drug properties. Some of the antisense agents available in the art include phosphorothioate or deoxyoligonucleotides, and in this situation a sulfur group is exchanged for a nonbridging oxygen on the phosphate backbone. This increases the resistance to RNase degradation and improves the pharmacologic stability. Yet in other agents, so-called "the next generation of antisense molecules," the oligonucleotides the 2'-O-methoxyethyl modification to the backbone, which can increase the affinity for these oligonucleotides for the target RNA. However, in some cases, many of these agents are associated with side effects, such as unwanted immune responses. At least in some situations, such undesirable properties of these agents are attributable at least in part to their stereorandom nature. The present invention provides stereodefined counterpart having preferred properties, such as improved lipophilicity and increased RNA binding.

A number of antisense-based therapeutics have been developed or in development. Non-limiting examples of antisense therapies are provided below. Stereo-defined (e.g., chirally pure) oligonucleotides as described herein can be prepared for achieving improved efficacy, increased affinity to target, reduced side effects, improved pharmacokinetics, enhanced stability and/or increased bioavailability, relative to the antisense drugs currently available in the art. In some embodiments, antisense therapeutics include Morpholino drugs. See, for example: Morcos, P A (2007). "Achieving targeted and quantifiable alteration of mRNA splicing with Morpholino oligos". *Biochem Biophys Res Commun* 358 (2): 521-7.

Cytomegalovirus Retinitis:

Fomivirsen (marketed as Vitravene), was approved by the U.S. FDA in August 1998 as a treatment for cytomegalovirus retinitis.

Hemorrhagic Fever Viruses:

In early 2006, scientists studying the Ebola hemorrhagic fever virus at USAMRIID announced a 75% recovery rate after infecting four rhesus monkeys and then treating them with an antisense Morpholino drug developed by AVI BioPharma, a U.S. biotechnology firm. [U.S. Army Medical Research Institute of Infectious Diseases, Fort Detrick, Md. News Release: Gene-Specific Ebola Therapies Protect Nonhuman Primates from Lethal Disease. Jan. 13, 2006] The usual mortality rate for monkeys infected with Ebola virus is 100%. In late 2008, AVI BioPharma successfully filed Investigational New Drug (IND) applications with the FDA for its two lead products for Marburg and Ebola viruses. These drugs, AVI-6002 (Lu, X; Yu, Q; Binder, GK; Chen, Z; Slepushkina, T; Rossi, J; Dropulic, B (2004). "Antisense-Mediated Inhibition of Human Immunodeficiency Virus (HIV) Replication by Use of an HIV Type 1-Based Vector Results in Severely Attenuated Mutants Incapable of Developing Resistance". Journal of Virology 78 (13): 7079-88) and AVI-6003 are novel analogs based on AVI's PMO antisense chemistry in which anti-viral potency is enhanced by the addition of positively-charged components to the morpholino oligomer chain. Preclinical results of AVI-6002 and AVI-6003 demonstrated reproducible and high rates of survival in non-human primates challenged with a lethal infection of the Ebola and Marburg viruses, respectively (Medical News Today. AVI BioPharma Announces FDA Clears IND Applications For Clinical Trials Of RNA Therapeutic Agents For Treatment Of Ebola And Marburg Viruses. 30 Dec. 2008).

Cancer:

Also in 2006, German physicians reported on a dose-escalation study for the compound AP 12009 (a phosphorothioate antisense oligodeoxynucleotide specific for the mRNA of human transforming growth factor TGF-beta2) in patients with high grade gliomas. At the time of the report, the median overall survival had not been obtained and the authors hinted at a potential cure (Results of G004, a phase IIb actively controlled clinical trial with the TGF-b2 targeted compound AP 12009 for recurrent anaplastic astrocytoma—Hau et al. 24 (18 Supplement): 1566—ASCO Meeting Abstracts).

For example, trabedersen (AP 12009-P001) is developed as monotherapy for the treatment of patients with advanced pancreatic cancer, malignant melanoma, brain tumors, anaplastic astrocytoma, and colorectal carcinoma. AP 12009-P001 has been evaluated in an open-label, multicenter, Phase 1/II dose escalation trial to evaluate safety and tolerability of i.v. administration of trabedersen in 61 patients with advanced solid tumors known to overproduce TGF-b2, who were either not or no longer amenable to established forms of therapies.

Other examples of antisense drugs that target proteins overexpressed in cancers include: Clusterin (OGX-011/TV01011), which regulates epithelial-mesenchymal transition induced by the growth factor TGF beta and the transcription factor TWIST1 in prostate cancer cells; ATL1101 (a second generation antisense inhibitor of the insulin-like growth factor-I receptor (IGF-IR)) in prostate cancer treatment; oblimersen (trade name: Genasense) for treating chronic lymphocytic leukemia; G4460 and LR3001 (inhibitors of c-myb) for the treatment of CML, melanoma, neuroblastoma, and cancers of the breast, pancreas and colon; MG98 (inhibitor of DNA methyltransferase I) for the treatment of renal cell carcinoma; ISIS 5132 (c-Raf antisense); LY900003 (Protein kinase C-alpha antisense); G3139 (Bcl-2 antisense), etc.

HIV/AIDS:

Starting in 2004, researchers in the US have been conducting research on using antisense technology to combat HIV. It is known that antisense-mediated inhibition of human immunodeficiency virus (HIV) replication by use of an HIV type 1-based vector results in severely attenuated mutants incapable of developing resistance. In February 2010 researchers reported success in reducing HIV viral load using patient T-cells which had been harvested, modified with an RNA antisense strand to the HIV viral envelope protein, and re-infused into the patient during a planned lapse in retroviral drug therapy.

High Cholesterol:

In 2010 mipomersen (previously ISIS 301012, trade name Kynamro) successfully completed phase 3 trials for some types of high cholesterol. Mipomersen is a cholesterol-reducing drug candidate. It is an antisense therapeutic that targets the messenger RNA for apolipoprotein B. See: Merki E, Graham M J, Mullick A E, et al. (August 2008). "Antisense oligonucleotide directed to human apolipoprotein B-100 reduces lipoprotein(a) levels and oxidized phospholipids on human apolipoprotein B-100 particles in lipoprotein(a) transgenic mice". Circulation 118 (7): 743-53; El Harchaoui K, Akdim F, Stroes E S, Trip M D, Kastelein J J (2008). "Current and future pharmacologic options for the management of patients unable to achieve low-density lipoprotein-cholesterol goals with statins". Am J Cardiovasc Drugs 8 (4): 233-42; Athyros V G, Kakafika A I, Tziomalos K, Karagiannis A, Mikhailidis D P (July 2008). "Antisense technology for the prevention or the treatment of cardiovascular disease: the next blockbuster?". Expert Opin Investig Drugs 17 (7): 969-72. It is administered as a weekly injection. The compound is a 'second-generation' antisense oligonucleotide; the nucleotides are linked with phosphorothioate linkages rather than the phosphodiester linkages of RNA and DNA, and the sugar parts are deoxyribose in the middle part of the molecule and 2'-O-methoxyethyl-modified ribose at the two ends. These modifications make the drug resistant to degradation by nucleases, allowing it to be administered weekly. The drug accumulates in the liver, which is convenient since apolipoprotein B predominantly acts there. The complete sequence is G*-C*-C*-U*-d A-dG-dT-dC-dT-dG-dmC-dT-dT-dmC-G*-C*-A*-C*-C* (SEQ ID NO: 113) [d=2'-deoxy, *=2'-O-(2-methoxyethyl)] with 3'-5' phosphorothioate linkages. The Phase 3 trials were in patients with familial hypercholesterolemia (FH), both homozygous (ho) and heterozygous (he). FH is a genetic disorder that causes exceptionally high levels of low-density lipoprotein cholesterol. Both trials showed exceptional performance with the highest efficacy seen so far in those two patient populations, and with relatively low drop-out rates compared to other injectable drugs.

Duchenne Muscular Dystrophy:

In Duchenne muscular dystrophy (DMD), the patient's muscle cells break down and are lost, leading to progressive muscle weakness and death. AVI-4658 is a targeted antisense therapy to restore expression of dystrophin, a key protein which patients with Duchenne muscular dystrophy lack. Results from an open-label, phase 2, dose-escalation study with 19 patients showed that when treatment was completed, a muscle biopsy was taken from each patient. The team discovered that the patients' ability to produce functional mRNA through "exon skipping' was repaired with the use of AVI-4658, eventually allowing them to manufacture functional dystrophin protein.

Myotonic Dystrophy:

Myotonic dystrophy is the most common muscular disease in adults, affecting mainly the skeletal muscles, heart and central nervous system. It occurs because of a mutation that causes numerous repeats of three letters of the genetic code (CTG) in a gene called DMPK. The messenger RNA that is produced from the mutated gene also contains the abnormal long repeats that cause the RNA to accumulate in the cell's nucleus. There it sequesters and blocks the function of a protein called Muscleblind-like 1 and activates another protein called CELF1. These proteins antagonize one another and the result is abnormal expression of proteins from many other genes in adult tissues, resulting in disease. To counteract this, Cooper and his colleagues created antisense oligonucleotides that are simply strands of genetic material that seek out portions of the abnormal RNA repeats and target RNase H to the toxic RNA causing its degradation. It was also reported that combining the antisense oligonucleotides with other antisense oligonucleotides that help released the sequestered Muscleblind-like1 can enhance the effect.

Diabetes:

SGLT2 (ISIS 388626) is an antisense drug to achieve reduction in sodium dependent glucose co-transporter type 2 (SGLT2) levels that resulted in a significant reduction in blood glucose levels in diabetic patients.

Hepatitis:

Persistent hepatitis C virus (HCV) infection is a leading cause of liver disease. Antisense oligonucleotides represent a promising class of antiviral agents. Such drugs under development include ISIS 14803, which is a 20-unit phosphorothioate oligodeoxynucleotide that inhibits HCV replication and protein expression.

Methods of Treatment

Provided oligonucleotides and compositions thereof, described herein, are useful as therapeutic agents against various disease states, including use as antiviral agents. In some embodiments, provided oligonucleotides can be used as agents for treatment of diseases through modulation of DNA and/or RNA activity. In some embodiments, provided oligonucleotides can be used for inhibiting specific gene expression. For example, a provided oligonucleotide can be complementary to a specific target messenger RNA (mRNA) sequence. It can be used to inhibit viral replication of myriad viruses. Exemplary virus families include orthomyxoviruses, pox viruses, herpes viruses, papilloma viruses, picomaviruses, flaviviruses, retroviruses, hepatitis viruses, paramyxoviruses, reoviruses, parvoviruses, filoviruses, coronaviruses, arenaviruses, rhabdoviruses and adenoviruses. Additional virus families are known and are also contemplated herein. Other examples include uses as antisense compounds against HIV RNA or other retroviral RNA or for hybridizing to HIV mRNA encoding the tat protein, or to the TAR region of HIV mRNA. In some embodiments, the nucleic acids mimic the secondary structure of the TAR region of HIV mRNA, and by doing so bind the tat protein. In some embodiments, a provided oligonucleotide is used to inhibit expression of a target protein by contacting a cell with a provided oligonucleotide, wherein the expression of other proteins in the cell are not inhibited or are minimally inhibited. In some embodiment, target protein inhibition occurs in vivo in a mammal. In some embodiments, a therapeutically effective amount of a provided oligonucleotide is administered for inhibiting the expression of a target protein.

Other examples of proteins where expression can be modulated include Jun N-terminal kinase (JNK) proteins, diacylglycerol acyltransferase I, apolipoprotein B, glucagon receptor, Aurora B, acyl CoA cholesterol acyltransferase-2, c-reactive protein, STAT (signal transducers and activators of transcription) family of proteins, and MDR P-glycoprotein. In some embodiments, a provided oligonucleotide can be used to inhibit protein phosphatase 1B (PTP1B) expression, RNA-dependent RNA viral polymerase. In some embodiments, a provided oligonucleotide can be used to induce events such as apoptosis in cancer cells or to make a cell more susceptible to apoptosis. In some embodiments, a provided oligonucleotide can be used to modulate activities of proteins. In some embodiments, a provided oligonucleotide can help modulate RNase H activity targeting multidrug resistance (MDR) RNA molecules.

In some embodiments, the present invention provides methods of treating a disease mediated by undesired gene expression in a subject (e.g., mammals, such as humans) in need of such treatment. By "diseases" is meant diseases, or disease symptoms. Methods include, e.g., administering to the subject an effective amount of a provided oligonucleotide.

Examples of diseases mediated by undesired gene expression include cancer (e.g., leukemia, tumors, and metastases), allergy, asthma, obesity, inflammation (e.g., inflammatory diseases such as inflammatory airways disease), hypercholesterolemia, hematological disorders, severe acute respiratory syndrome (SARS), obstructive airways disease, asthma, autoimmune diseases, retroviral diseases such as AIDS or HIV, other viral infections, intrauterine infections, metabolic diseases, infection (e.g., bacterial, viral, yeast, fungal), CNS diseases, brain tumors, degenerative neural diseases, cardiovascular diseases, and diseases associated with angiogenesis, neovascularization, and vasculogenesis.

In some embodiments, provided oligonucleotides are useful for treating cancer, including pancreatic cancer, and other diseases or disorders involving abnormal cell proliferation.

Located in the upper abdomen (in the retroperitoneum), the pancreas is a dual-function gland of the digestive and endocrine system. In certain instances, the pancreas functions as an endocrine gland (e.g., producing several important hormones). In certain instances, the pancreas functions as an exocrine gland (e.g., secreting fluids containing digestive enzymes that pass to the small intestine).

Pancreatic cancer is the fourth most common cause of cancer death in the US (after lung, colon and breast), comprising 6% of all cancer-related deaths. In 2008, an estimated 37,680 new cases of pancreatic cancer will have been diagnosed in the US, with 34,290 deaths. Incidence of the disease, rises linearly after age 50, with the only definitive risk factor being cigarette smoking (smokers are four times more likely to develop the disease than non-smokers). Invasive pancreatic cancer is almost always fatal. The collective median survival time of all patients is 4-6 months. Relative 1-year survival is 24%; the overall 5-year survival rate <5%.

Pancreatic cancer is asymptomatic in its early stage and often remains undiagnosed for several months (less than one third of patients being diagnosed within 2 months of the onset symptoms). In certain instances, the delayed diagnosis results in (either partially or fully) metastasis of the cancerous cells to the liver or lymph nodes.

Currently, surgery (resectioning of the pancreas) is the primary and only curative therapy for pancreatic cancer. However, only 15-25% of tumors are resectable at the time of diagnosis and only 10-20% of patients undergoing surgery survive more than two years. Once tumor infiltration occurs and other tissues have been affected, surgery is no longer possible.

In certain instances, diabetes mellitus or pancreatitis predisposes an individual to develop a proliferative disorder of a plurality of pancreatic cells. In certain instances, individuals are at an increased risk of developing a proliferative disorder of a plurality of pancreatic cells due to a hereditary syndrome selected from the group consisting of hereditary nonpolyposis colorectal cancer (HNPCC) and familial adenomatous polyposis (FAP). In certain instances, individuals are at an increased risk of developing a proliferative disorder of a plurality of pancreatic cells due to a mutation in a gene selected from the group consisting of MSH2, MSH6, MLH1, and APC.

Ideally, effective treatment of pancreatic cancer should (i) control the primary tumor mass, both initially and subsequently, and (ii) treat the metastatic tumor cells. Chemoprevention (the administration of agents such as drugs, biologics, nutrients and the like) slows the progression of, reverses, or inhibits carcinogenesis, thereby lowering the risk of developing invasive or clinically significant disease.

Disclosed herein, in certain embodiments, are methods of treating pancreatic cancer. As used herein, "pancreatic cancer" includes forms of cancer of the pancreas. In some embodiments, a pancreatic cancer is metastatic pancreatic cancer. In some embodiments, a pancreatic cancer is a carcinoma, sarcoma, cancer, or combinations thereof. In some embodiments, a pancreatic cancer to be treated includes sporadic and hereditary pancreatic cancers. In some embodiments, a pancreatic cancer is duct cell carcinoma, acinar cell carcinoma, papillary mucinous carcinoma, signet ring carcinoma, adenosquamous carcinoma, undifferentiated carcinoma, mucinous carcinoma, giant cell carcinoma, small cell carcinoma, cystcancer, serous cystcancer, mucinous cystcancer, unclassified pancreatic cancer, pancreatoblastoma, or combinations thereof.

In some embodiments, an individual in need of treatment for pancreatic cancer presents with a localized tumor of the pancreas. In some embodiments, an individual in need of treatment for pancreatic cancer presents with a negative regional lymph node biopsy. In some embodiments, an individual in need of treatment for pancreatic cancer presents with a positive regional lymph node biopsy. In some embodiments, an individual in need of treatment for pancreatic cancer presents with a nodal negative pancreatic tumor (e.g., node-negative). In some embodiments, an individual in need of treatment for pancreatic cancer presents with a nodal positive tumor (e.g., node-positive).

In some embodiments, a pancreatic cancer in an individual in need of treatment for pancreatic cancer has metastasized to other locations in the body. In some embodiments, a pancreatic cancer has metastasized to a location selected from the group consisting of lymph node, stomach, bile duct, liver, bone, ovary, peritoneum and brain.

In some embodiments, cancer cells or precancerous cells are identified by histological typing or grading of a tissue sample (e.g., a biopsy sample). In some embodiments, cancer cells or precancerous cells are identified through the use of appropriate molecular markers.

In some embodiments, a pancreatic cancer in an individual in need of treatment for pancreatic cancer is staged according to the American Joint Committee on Cancer (AJCC) TNM classification system, where the tumor (T) has been assigned a stage of Tx, T1, T2, T3, T4; and where the regional lymph nodes (N) have been assigned a stage of NX, N0, N1; and where distant metastasis (M) has been assigned a stage of MX, M0, or M1. In some embodiments, a pancreatic cancer in an individual in need of treatment for pancreatic cancer is staged as Stage 0, I, IA, IB, II, IIA, IIB, III, and IV pancreatic cancer. In some embodiments, a pancreatic cancer in an individual in need of treatment for pancreatic cancer is staged as Grade GX (e.g., grade cannot be assessed), Grade 1, Grade 2, Grade 3 or Grade 4.

More specific examples of cancers treated with provided oligonucleotides include breast cancer, lung cancer, melanoma, colorectal cancer, bladder cancer, ovarian cancer, prostate cancer, renal cancer, squamous cell cancer, glioblastoma, Kaposi's sarcoma, multiple myeloma, and leukemia.

Evaluation and Treatment of Cancer

The term "tumor cell antigen" is defined herein as an antigen that is present in higher quantities on a tumor cell or in body fluids than unrelated tumor cells, normal cells, or in normal body fluid. The antigen presence may be tested by any number of assays known to those skilled in the art and include without limitation negative and/or positive selection with antibodies, such as an ELISA assay, a radioimmunoassay, or by Western Blot.

"Apoptosis inducing agent" is defined herein to induce apoptosis/programmed cell death, and include, for example, anticancer agents and treatments wherein cells (e.g., tumor cells) are induced to undergo programmed cell death. Exemplary apoptosis inducing agents are described in more detail below.

The terms "apoptosis" or "programmed cell death," refers to the physiological process by which unwanted or useless cells are eliminated during development and other normal biological processes. Apoptosis is a mode of cell death that occurs under normal physiological conditions and the cell is an active participant in its own demise ("cellular suicide"). It is most often found during normal cell turnover and tissue homeostasis, embryogenesis, induction and maintenance of immune tolerance, development of the nervous system and endocrine-dependent tissue atrophy. Cells undergoing apoptosis show characteristic morphological and biochemical features. These features include chromatin aggregation, nuclear and cytoplasmic condensation, partition of cytoplasm and nucleus into membrane bound vesicles (apoptotic bodies), which contain ribosomes, morphologically intact mitochondria and nuclear material. In vivo, these apoptotic bodies are rapidly recognized and phagocytized by macrophages, dendritic cells or adjacent epithelial cells. Due to this efficient mechanism for the removal of apoptotic cells in vivo no inflammatory response is elicited. In vitro, the apoptotic bodies as well as the remaining cell fragments ultimately swell and finally lyse. This terminal phase of in vitro cell death has been termed "secondary necrosis." Apoptosis can be measured by methods known to those skilled in the art like DNA fragmentation, exposure of Annexin V, activation of caspases, release of cytochrome c, etc. A cell that has been induced to die is termed herein as an "apoptotic cell." Apoptosis can also be tested using a standard Annexin V Apoptosis Assay: NIH:OVCAR-3 cells are grown in 6-well plates (NUNC) and irradiated or treated with an antagonist (or in combination with another anticancer drug) for 4-48 hours, washed and stained with Annexin V-FITC (BD-Pharmingen) for 1 hour. Cells are analyzed by flow cytometry (Becton-Dickinson, CellQuest), counterstained with Propidium Iodide and analyzed again in the flow cytometer.

Patients can be assessed with respect to symptoms at one or more multiple time points including prior to, during, and after treatment regimens. Treatment can result in improving the subject's condition and can be assessed by determining if one or more of the following factors has occurred: decreased tumor size, decreased cell proliferation, decreased numbers of cells, decreased neovascularization, increased apoptosis, or decreased survival of at least a portion of the tumor cells. One or more of these occurrences may, in some cases, result in partial or total elimination of the cancer and prolongation of survival of the patient. Alternatively, for terminal stage cancers, treatment may result in stasis of disease, better quality of life and/or prolongation of survival.

Methods of Assaying Cell Migration

Assays for cell migration have been described in the literature, e.g., by Brooks, et al., J. Clin. Invest 1997, 99:1390-1398 and methods for measuring cell migration are known to those of skill in the art. In one method for measuring cell migration described herein, membranes from transwell migration chambers are coated with substrate, the transwells washed, and non-specific binding sites blocked with BSA. Tumor cells from sub-confluent cultures are harvested, washed, and resuspended in migration buffer in the presence or absence of assay antibodies. After the tumor cells are allowed to migrate to the underside of the coated transwell membranes, the cells remaining on the top-side of the membrane are removed and cells that migrate to the under-side are stained with crystal violet. Cell migration is then quantified by direct cell counts per microscopic field.

Methods of Assaying Tumor Growth

Tumor growth can be assayed by methods known to those of skill in the art, e.g., the SCID mouse model, the nude mouse model, and BALB/c mice with syngeneic tumors. SCID mouse models for tumor growth are carried out as follows: subconfluent human M21 melanoma cells (or any desired tumor cell type) are harvested, washed, and resuspended in sterile PBS ($20 \times 10^6$ per mL). SCID mice are injected subcutaneously with 100 µL of M21 human melanoma cell ($2 \times 10^6$) suspension. Three days after tumor cell injection, mice are either untreated or treated intraperitoneally with an antagonist in the desired dose ranges. The mice are treated daily for 24 days. Tumor size is measured with calipers and the volume estimated using the formula $V=(L \times W^2)/2$, where V is equal to the volume, L is equal to the length, and W is equal to the width.

Alternatively, nude mouse models, SCID mouse models and/or BALB/c syngeneic mouse models can also be utilized to assess tumor growth and inhibition thereof by the humanized anti-endoglin antibodies or antigen-binding fragments described herein.

Methods of Assaying Cell Proliferation

Cell proliferation can be assayed by methods known to those of skill in the art. As described herein, subconfluent human endothelial cells (HUVECs) can be resuspended in proliferation buffer containing low (5.0%) serum in the presence or absence of CM (25 μL) from ECV or ECVL cells, and endothelial cells allowed to proliferate for 24 hours. Proliferation can be quantified by measuring mitochondrial dehydrogenase activity using a commercially available WST-1 assay kit (Chemicon). Also, as described herein, proliferation can be quantified by measuring 3H incorporation using standard methods. (She et al., Int. J. Cancer, 108: 251-257 (2004)).

Other methods of assessing cell proliferation are known in the art and are contemplated herein. Further non-limiting examples are described in more detail in the examples.

One would understand that classification and staging systems described herein represent one means to assess treatment of cancers described herein; additionally, other staging schemes are known in the art and may be used in connection with the methods described herein. By way of example only, the TNM classification of malignant tumors may be used as a cancer staging system to describe the extent of cancer in a patient's body. T describes the size of the tumor and whether it has invaded nearby tissue, N describes regional lymph nodes that are involved, and M describes distant metastasis. TNM is maintained by the International Union Against Cancer (UICC) and is used by the American Joint Committee on Cancer (AJCC) and the International Federation of Gynecology and Obstetrics (FIGO). One would understand that not all tumors have TNM classifications such as, for example, brain tumors. Generally, T (a,is,(0), 1-4) is measured as the size or direct extent of the primary tumor. N (0-3) refers to the degree of spread to regional lymph nodes: N0 means that tumor cells are absent from regional lymph nodes, N1 means that tumor cells spread to the closest or small numbers of regional lymph nodes, N2 means that tumor cells spread to an extent between N1 and N3; N3 means that tumor cells spread to most distant or numerous regional lymph nodes. M (0/1) refers to the presence of metastasis: M0 means that no distant metastasis are present; M1 means that metastasis has occurred to distant organs (beyond regional lymph nodes). Other parameters may also be assessed. G (1-4) refers to the grade of cancer cells (i.e., they are low grade if they appear similar to normal cells, and high grade if they appear poorly differentiated). R (0/1/2) refers to the completeness of an operation (i.e., resection-boundaries free of cancer cells or not). L (0/1) refers to invasion into lymphatic vessels. V (0/1) refers to invasion into vein. C (1-4) refers to a modifier of the certainty (quality) of V.

Provided herein are methods for degrading, inhibiting the growth of or killing cancer cells comprising contacting the cells with an amount of a compound described herein effective to degrade, inhibit the growth of or kill cancer cells.

Provided herein are methods of inhibiting tumor size increase, reducing the size of a tumor, reducing tumor proliferation or preventing tumor proliferation in an individual comprising administering to said individual an effective amount of a compound described herein to inhibit tumor size increase, reduce the size of a tumor, reduce tumor proliferation or prevent tumor proliferation. Treatment of tumors in some cases includes stasis of symptoms, that is, by treating the patient, the cancer does not worsen and survival of the patient is prolonged.

Patients may be assessed with respect to symptoms at one or more multiple time points including prior to, during, and after treatment regimens. Treatment can result in improving the subject's condition and can be assessed by determining if one or more of the following events has occurred: decreased tumor size, decreased tumor cell proliferation, decreased numbers of cells, decreased neovascularization and/or increased apoptosis. One or more of these occurrences may, in some cases, result in partial or total elimination of the cancer and prolongation of survival of the patient. Alternatively, for terminal stage cancers, treatment may result in stasis of disease, better quality of life and/or prolongation of survival.

Other methods of assessing treatment are known in the art and contemplated herein. In an exemplary embodiment, the pro-oligonucleotide compounds of the invention are administered to a subject such as a mammal (e.g., a human), suffering from a medical disorder, e.g., a cancer, or non-malignant conditions characterized by the presence of a class of unwanted cells.

Primary outcome measures may be assessed for patients treated using the methods described herein and include, for example, progression-free survival. In one embodiment, an increase in progression free survival is observed in an amount of by about 2-fold, 5-fold, 10-fold, 20 fold, 50 fold or more compared to lack of treatment. In another embodiment, an increase in progression free survival is increased survival by about 3 months, about 6 months, about 9 months, about 12 months, about 18 months, about 2 years, about 3 years, about 4 years, about 5 years or more compared to lack of treatment.

Secondary outcome measures may also be assessed and include duration of response, time to tumor progression, overall survival, serious and non-serious adverse events. For example, a treatment may prevent progression of the disease (i.e., stasis) or may result in an improvement. Alternately, or in addition, other goals can be measured with respect to one or more of the following: decreased tumor burden, decreased neovascularization, reduced side effects, decreased adverse reactions, and/or increased patient compliance.

Other specific examples of diseases or disorders for which treatment by the compounds or compositions of the invention are useful for treatment or prevention include, but are not limited to transplant rejection (e.g., kidney, liver, heart, lung, islet cells, pancreas, bone marrow, cornea, small bowel, skin allografts or xenografts and other transplants), graft vs. host disease, osteoarthritis, rheumatoid arthritis, multiple sclerosis, diabetes, diabetic retinopathy, inflammatory bowel disease (e.g., Crohn's disease, ulcerative colitis, and other bowel diseases), renal disease, cachexia, septic shock, lupus, myasthenia gravis, psoriasis, dermatitis, eczema, seborrhea, Alzheimer's disease, Parkinson's disease, stem cell protection during chemotherapy, ex vivo selection or ex vivo purging for autologous or allogeneic bone marrow transplantation, ocular disease, retinopathies (e.g., macular degeneration, diabetic retinopathy, and other retinopathies), corneal disease, glaucoma, infections (e.g., bacterial, viral, or fungal), heart disease, including, but not limited to, restenosis.

Activation of RNAse L

The 2'-5' oligoadenylate (2-5A)/RNase L pathway is one of the enzymatic pathways induced by interferon. Rpase L is activated after binding to 5'-phosphorylated fragments of 2'-5' adenylic acid. These fragments of 2'-5' adenylic acid (2-5A) are produced under the control of 2'-5' oligo(A) synthetase. This pathway is part of the innate immune system and has an important role in preventing viral infection. 2-5A-Induced cleavage of single-stranded RNA results in apoptosis. Biostable phosphorothioate analogs of 2-5A have been shown to be potent activators of Rpase L (Xianh et al., Cancer Research (2003), 63:6795-6801). In this study, the 2-5A analogs induced Rpase L activity and caused apoptosis in cultures of late-stage, metastatic human prostate cancer cell lines DU145, PC3 and LNCaP.

Sustained activation of RNase L triggers a mitochondrial pathway of apoptosis that eliminates virus-infected cells as well as cancerous/tumor cells. RNase L can inhibit fibrosarcoma growth, prostate cancer growth, colorectal cancer growth and pancreatic cancer growth. Given the common role of RNase L in different cancers, it is contemplated that the invention described herein can be use for the treatment of any type of cancer. Silverman, R H, Cytokine Growth Factor Rev, 18(5-6): 381-388 (2007); Bisbal, C. and Silverman, R H, *Biochimie*. 89(6-7): 789-798 (2007). By way of example, downregulation of RNase L refers to any reduction in expression levels of the gene or genes encoding RNase L, silencing of the gene or genes encoding RNase L, reduction in the levels of expression/translation of the proteins comprising RNase L, reduction in the amount of RNase L present within a cell, and/or any reduction in activity of RNase L as compared to a predetermined level of RNase L in an exemplary healthy population. Alternatively any reduction in RNase L levels as described herein can be indicative of downregulation of RNase L.

In some embodiments, provided oligonucleotides are useful for the treatment of diseases having downregulated RNase L. In some embodiment, a disease associated with downregulated RNase L is cancer. In some embodiments, the cancer is pancreatic cancer, prostate cancer, or colorectal cancer. Alternatively, provided oligonucleotides described herein are useful for the treatment of disease having upregulated RNase L. In some embodiments, the disease having upregulated RNase L is chronic fatigue syndrome. Additional diseases having upregulated RNase L are known in the art and contemplated herein.

When used as therapeutics, a provided oligonucleotide is administered as a pharmaceutical composition. In some embodiments, the pharmaceutical composition comprises a therapeutically effective amount of a provided oligonucleotide comprising, or a pharmaceutically acceptable salt thereof, and at least one pharmaceutically acceptable inactive ingredient selected from pharmaceutically acceptable diluents, pharmaceutically acceptable excipients, and pharmaceutically acceptable carriers. In another embodiment, the pharmaceutical composition is formulated for intravenous injection, oral administration, buccal administration, inhalation, nasal administration, topical administration, ophthalmic administration or otic administration. In further embodiments, the pharmaceutical composition is a tablet, a pill, a capsule, a liquid, an inhalant, a nasal spray solution, a suppository, a suspension, a gel, a colloid, a dispersion, a suspension, a solution, an emulsion, an ointment, a lotion, an eye drop or an ear drop.

Pharmaceutical Compositions

When used as therapeutics, a provided oligonucleotide or oligonucleotide composition described herein is administered as a pharmaceutical composition. In some embodiments, the pharmaceutical composition comprises a therapeutically effective amount of a provided oligonucleotides, or a pharmaceutically acceptable salt thereof, and at least one pharmaceutically acceptable inactive ingredient selected from pharmaceutically acceptable diluents, pharmaceutically acceptable excipients, and pharmaceutically acceptable carriers. In some embodiments, the pharmaceutical composition is formulated for intravenous injection, oral administration, buccal administration, inhalation, nasal administration, topical administration, ophthalmic administration or otic administration. In some embodiments, the pharmaceutical composition is a tablet, a pill, a capsule, a liquid, an inhalant, a nasal spray solution, a suppository, a suspension, a gel, a colloid, a dispersion, a suspension, a solution, an emulsion, an ointment, a lotion, an eye drop or an ear drop.

In some embodiments, the present invention provides a pharmaceutical composition comprising chirally controlled oligonucleotide, or composition thereof, in admixture with a pharmaceutically acceptable excipient. One of skill in the art will recognize that the pharmaceutical compositions include the pharmaceutically acceptable salts of the chirally controlled oligonucleotide, or composition thereof, described above.

Compounds for Enhancing and Targeting Delivery

A provided oligonucleotide as described herein can be delivered using a variety of delivery strategies, including conjugates of nucleic acids with various ligands, as well as use of nanocarrier approaches. Any nucleic acid delivery strategies are contemplated for use with provided oligonucleotides described herein. The choice between exemplary delivery strategies, including but not limited to, chemical conjugates, cationic lipid/liposomal transfer vessicles and supramolecular nanocarriers depends on the therapeutic context, and methods for determining the optimal delivery modality are known in the art and further contemplated herein.

Cell Penetrating Compounds ("CPCs")

Numerous compounds are known to act as carriers for cargo such as nucleic acids and facilitate entry of the nucleic acid in a cell in an in vivo setting. Exemplary carriers are described in Dietz et al., Molecular & Cellular Neuroscience, 27(2): 85-131 (2004) which is incorporated herein by reference. The prototypical CPCs derived from the Tat and antennepedia transcriptional regulators have been joined by a large number of new moieties. As an example, CPCs that are peptides can be relatively short (9-30 amino acids) polycationic peptides rich in argine and lysine, or membrane-interactive hydrophobic sequences. CPCs can be linked by recombinant DNA techniques or chemically coupled to peptides, oligonucleotides or nanocarriers, which then comprise the 'cargo' for the CPC.

Cell Targeting Ligands ("CTLs")

Another strategy is to deliver oligonucleotides by use of a CTL that binds with high affinity to a cell surface receptor that is capable of undergoing efficient internalization. Potential ligands include antibodies, polypeptides derived from phage display libraries, and small organic molecules. Additional cell-targeting ligands are known in the art, or will be developed, and are contemplated for use with the invention described herein (for ASGPR-GalNAc conjugated siRNA and oligonucleotides, e.g., WO2012037254A1). Because various receptors are often preferentially expressed on particular cell types, this approach offers the possibility of improved selectivity for the oligonucleotide reagents. Exemplary receptor targets include, but are not limited to, lipoprotein receptors (such as those in the liver), integrins, receptor tyrosine kinases, and the G-protein coupled receptor (GPCR) superfamily.

Nanocarriers

A variety of supramolecular nanocarriers can be used to deliver nucleic acids. Exemplary nanocarriers include, but are not limited to liposomes, cationic polymer complexes and various polymeric. Complexation of nucleic acids with various polycations is another approach for intracellular delivery; this includes use of PEGylated polycations, polyethyleneamine (PEI) complexes, cationic block co-polymers, and dendrimers. Several cationic nanocarriers, including PEI and polyamidoamine dendrimers help to release contents from endosomes. Other approaches include use of polymeric nanoparticles, polymer micelles, quantum dots and lipoplexes.

Additional nucleic acid delivery strategies are known in addition to the exemplary delivery strategies described herein.

In therapeutic and/or diagnostic applications, the compounds of the invention can be formulated for a variety of modes of administration, including systemic and topical or localized administration. Techniques and formulations generally may be found in Remington, The Science and Practice of Pharmacy, (20th ed. 2000).

Provided oligonucleotides, and compositions thereof, are effective over a wide dosage range. For example, in the treatment of adult humans, dosages from about 0.01 to about 1000 mg, from about 0.5 to about 100 mg, from about 1 to about 50 mg per day, and from about 5 to about 100 mg per day are examples of dosages that may be used. The exact dosage will depend upon the route of administration, the form in which the compound is administered, the subject to be treated, the body weight of the subject to be treated, and the preference and experience of the attending physician.

Pharmaceutically acceptable salts are generally well known to those of ordinary skill in the art, and may include, by way of example but not limitation, acetate, benzenesulfonate, besylate, benzoate, bicarbonate, bitartrate, bromide, calcium edetate, carnsylate, carbonate, citrate, edetate, edisylate, estolate, esylate, fumarate, gluceptate, gluconate, glutamate, glycollylarsanilate, hexylresorcinate, hydrabamine, hydrobromide, hydrochloride, hydroxynaphthoate, iodide, isethionate, lactate, lactobionate, malate, maleate, mandelate, mesylate, mucate, napsylate, nitrate, pamoate (embonate), pantothenate, phosphate/diphosphate, polygalacturonate, salicylate, stearate, subacetate, succinate, sulfate, tannate, tartrate, or teoclate. Other pharmaceutically acceptable salts may be found in, for example, Remington, The Science and Practice of Pharmacy (20th ed. 2000). Preferred pharmaceutically acceptable salts include, for example, acetate, benzoate, bromide, carbonate, citrate, gluconate, hydrobromide, hydrochloride, maleate, mesylate, napsylate, pamoate (embonate), phosphate, salicylate, succinate, sulfate, or tartrate.

Depending on the specific conditions being treated, such agents may be formulated into liquid or solid dosage forms and administered systemically or locally. The agents may be delivered, for example, in a timed- or sustained-low release form as is known to those skilled in the art. Techniques for formulation and administration may be found in Remington, The Science and Practice of Pharmacy (20th ed. 2000). Suitable routes may include oral, buccal, by inhalation spray, sublingual, rectal, transdermal, vaginal, transmucosal, nasal or intestinal administration; parenteral delivery, including intramuscular, subcutaneous, intramedullary injections, as well as intrathecal, direct intraventricular, intravenous, intra-articullar, intra-sternal, intra-synovial, intra-hepatic, intralesional, intracranial, intraperitoneal, intranasal, or intraocular injections or other modes of delivery.

For injection, the agents of the invention may be formulated and diluted in aqueous solutions, such as in physiologically compatible buffers such as Hank's solution, Ringer's solution, or physiological saline buffer. For such transmucosal administration, penetrants appropriate to the barrier to be permeated are used in the formulation. Such penetrants are generally known in the art.

Use of pharmaceutically acceptable inert carriers to formulate the compounds herein disclosed for the practice of the invention into dosages suitable for systemic administration is within the scope of the invention. With proper choice of carrier and suitable manufacturing practice, the compositions of the present invention, in particular, those formulated as solutions, may be administered parenterally, such as by intravenous injection.

The compounds can be formulated readily using pharmaceutically acceptable carriers well known in the art into dosages suitable for oral administration. Such carriers enable the compounds of the invention to be formulated as tablets, pills, capsules, liquids, gels, syrups, slurries, suspensions and the like, for oral ingestion by a subject (e.g., patient) to be treated.

For nasal or inhalation delivery, the agents of the invention may also be formulated by methods known to those of skill in the art, and may include, for example, but not limited to, examples of solubilizing, diluting, or dispersing substances such as, saline, preservatives, such as benzyl alcohol, absorption promoters, and fluorocarbons.

Pharmaceutical compositions suitable for use in the present invention include compositions wherein the active ingredients are contained in an effective amount to achieve its intended purpose. Determination of the effective amounts is well within the capability of those skilled in the art, especially in light of the detailed disclosure provided herein.

In addition to the active ingredients, these pharmaceutical compositions may contain suitable pharmaceutically acceptable carriers comprising excipients and auxiliaries which facilitate processing of the active compounds into preparations which can be used pharmaceutically. The preparations formulated for oral administration may be in the form of tablets, dragees, capsules, or solutions.

Pharmaceutical preparations for oral use can be obtained by combining the active compounds with solid excipients, optionally grinding a resulting mixture, and processing the mixture of granules, after adding suitable auxiliaries, if desired, to obtain tablets or dragee cores. Suitable excipients are, in particular, fillers such as sugars, including lactose, sucrose, mannitol, or sorbitol; cellulose preparations, for example, maize starch, wheat starch, rice starch, potato starch, gelatin, gum tragacanth, methyl cellulose, hydroxypropylmethyl-cellulose, sodium carboxymethyl-cellulose (CMC), and/or polyvinylpyrrolidone (PVP: povidone). If desired, disintegrating agents may be added, such as the cross-linked polyvinylpyrrolidone, agar, or alginic acid or a salt thereof such as sodium alginate.

Dragee cores are provided with suitable coatings. For this purpose, concentrated sugar solutions may be used, which may optionally contain gum arabic, talc, polyvinylpyrrolidone, carbopol gel, polyethylene glycol (PEG), and/or titanium dioxide, lacquer solutions, and suitable organic solvents or solvent mixtures. Dye-stuffs or pigments may be added to the tablets or dragee coatings for identification or to characterize different combinations of active compound doses.

Pharmaceutical preparations that can be used orally include push-fit capsules made of gelatin, as well as soft, sealed capsules made of gelatin, and a plasticizer, such as glycerol or sorbitol. The push-fit capsules can contain the active ingredients in admixture with filler such as lactose, binders such as starches, and/or lubricants such as talc or magnesium stearate and, optionally, stabilizers. In soft capsules, the active compounds may be dissolved or suspended in suitable liquids, such as fatty oils, liquid paraffin, or liquid polyethylene glycols (PEGs). In addition, stabilizers may be added.

Depending upon the particular condition, or disease state, to be treated or prevented, additional therapeutic agents, which are normally administered to treat or prevent that condition, may be administered together with the inhibitors of this invention. For example, chemotherapeutic agents or other anti-proliferative agents may be combined with the inhibitors of this invention to treat proliferative diseases and cancer. Examples of known chemotherapeutic agents include, but are not limited to, adriamycin, dexamethasone, vincristine, cyclophosphamide, fluorouracil, topotecan, taxol, interferons, and platinum derivatives.

Other examples of agents the non-racemic pro-oligonucleotide of this invention may also be combined with include, without limitation, anti-inflammatory agents such as corticosteroids, TNF blockers, IL-1 RA, azathioprine, cyclophosphamide, and sulfasalazine; immunomodulatory and immunosuppressive agents such as cyclosporin, tacrolimus, rapamycin, mycophenolate mofetil, interferons, corticosteroids, cyclophophamide, azathioprine, and sulfasalazine; neurotrophic factors such as acetylcholinesterase inhibitors, MAO inhibitors, interferons, anti-convulsants, ion channel blockers, riluzole, and anti-Parkinsonian agents; agents for treating cardiovascular disease such as beta-blockers, ACE inhibitors, diuretics, nitrates, calcium channel blockers, and statins; agents for treating liver disease such as corticosteroids, cholestyramine, interferons, and anti-viral agents; agents for treating blood disorders such as corticosteroids, anti-leukemic agents, and growth factors; agents for treating diabetes such as insulin, insulin analogues, alpha glucosidase inhibitors, biguanides, and insulin sensitizers; and agents for treating immunodeficiency disorders such as gamma globulin.

These additional agents may be administered separately, as part of a multiple dosage regimen, from provided chirally controlled oligonucleotides, and composition thereof. Alternatively, these agents may be part of a single dosage form, mixed together with the provided chirally controlled oligonucleotides, and composition thereof, in a single composition.

The examples and preparations provided below further illustrate and exemplify provided oligonucleotides and compositions thereof, and methods of preparing the same. It is to be understood that the scope of the present invention is not limited in any way by the scope of the following examples and preparations.

The function and advantage of these and other embodiments of the present invention will be more fully understood from the examples described below. The following examples are intended to illustrate the benefits of the present invention, but do not exemplify the full scope of the invention.

Method of Analyzing Oligonucleotide Compositions

In some embodiments, the present invention provides methods for analyzing oligonucleotide compositions. In some embodiments, a provided method detects, determines, and/or quantifies, for example, the identity, purity, quantity and/or quality of one or more oligonucleotides. In some embodiments, the present invention provides a method comprising steps of:

a) performing a first analysis of a first composition, which first composition comprises a plurality of different types of an oligonucleotide; and b) comparing the performed first analysis with a second analysis, under comparable conditions as the first analysis, of a second composition, which second composition is a chirally controlled composition of the oligonucleotide, where differences between the first and second analyses reflect differences in presence or level of at least one type of the oligonucleotide in the first as compared with the second composition.

In some embodiments, a second composition contains only a single type of the oligonucleotide. In some embodiments, a second composition contains more than one types of the oligonucleotide. In some embodiments, a provided method is used for quality control of oligonucleotide compositions, for example, as illustrated in Examples 17 and 48. As will be appreciated by those skilled in the art, the presented data in Example 48 confirm that the depicted analyses comparing the compositions show that the random oligonucleotide composition (the first composition), as prepared by non-chiral controlled oligonucleotide synthesis, comprises extremely low level of certain oligonucleotide types, such as the full Rp or Sp type of the chirally controlled composition (the second composition).

EXEMPLIFICATION

The foregoing has been a description of certain non-limiting embodiments of the invention. Accordingly, it is to be understood that the embodiments of the invention herein described are merely illustrative of the application of the principles of the invention. Reference herein to details of the illustrated embodiments is not intended to limit the scope of the claims.

General Description of Oligonucleotide Synthesis

As described above and herein, in some embodiments, the present invention provides oligonucleotides and the methods of preparing the same. In some embodiments, the synthesis of oligonucleotide is performed using solid support. In some embodiments, the synthesis of oligonucleotide is performed in solution. In some embodiments, the synthesis of oligonucleotide comprises steps using solid support and steps in solution phase. In some embodiments, the steps using solid support are performed on an oligonucleotide synthesizer.

Preparation of the Solid Support:

The support (Highly Cross-linked Polystyrene (HCP) or Controlled Pore Glass (CPG)) was used to load the first 5'-O-DMTr protected nucleoside contained in the oligonucleotide sequence. In some embodiments, an oxalyl group was used to link the 3'-OH group of the first nucleoside to an amine group on the solid support, as described in Alul et al., Oxalyl-CPG: a labile support for synthesis of sensitive oligonucleotide derivatives, *Nucleic Acids Research* 1991, 19(7), 1527. In some embodiments, the standard succinyl group was used as the linker.

Detritylation of Nucleotide on the Solid Support:

A solution of 3% TCA (trichloroacetic acid) in dichloromethane (DCM, $CH_2Cl_2$) was delivered to the column containing the support which was installed on a synthesizer to de-block the 5'-O-DMTr.

CMPT-Mediated Chiral Phosphoramidite Coupling:

After washing of the solid support with anhydrous acetonitrile (ACN) and drying by reverse flush with dry argon, the free 5'-OH was coupled with the next nucleotide in the oligonucleotide sequence, growing from the 3' to the 5' end. This entailed co-delivery to the solid support of a solution of the chiral phosphoramidite together with CMPT (below), which resulted in highly efficient coupling with excellent diastereomeric excess (typically >99%) to give a chiral phosphite diester product, as described by Wada et al. *J. Am. Chem. Soc.,* 2008, 130, 16031-1603; *Angew. Chem. Intern. Ed.* 2009, 48, 496-499. The solvent was normally acetonitrile (ACN), but other solvents could also be used.

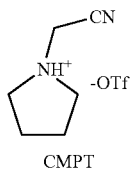

CMPT

Chiral Phosphoramidites Employed in these Studies:

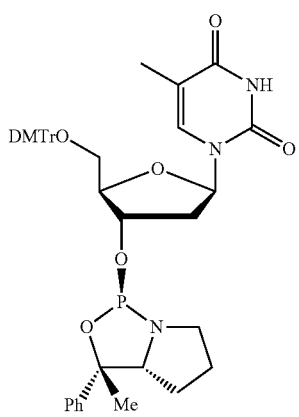

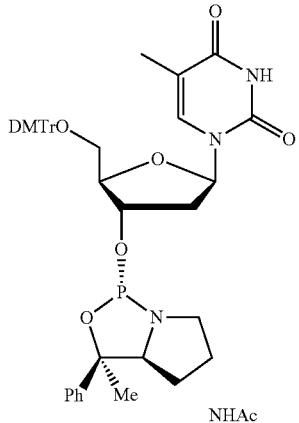

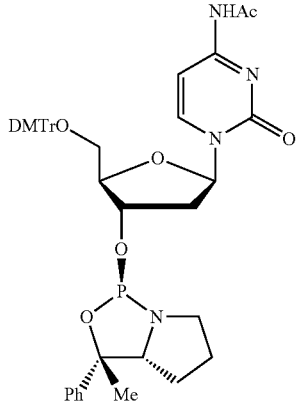

-continued

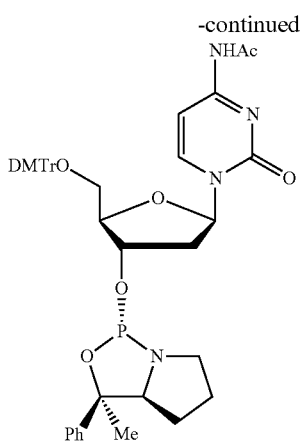

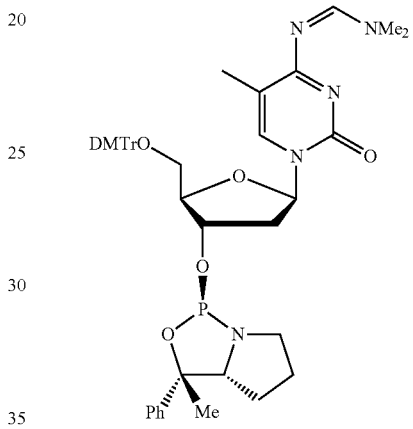

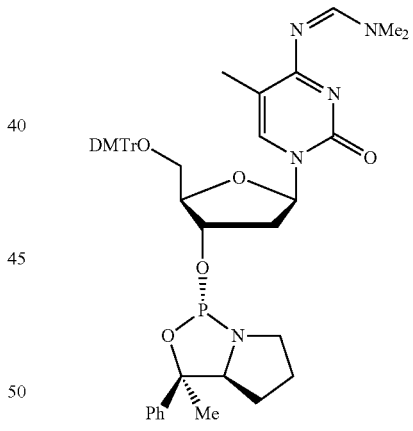

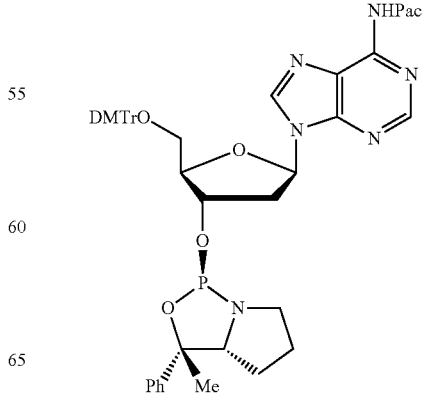

| 369 -continued | 370 -continued |
|---|---|
| 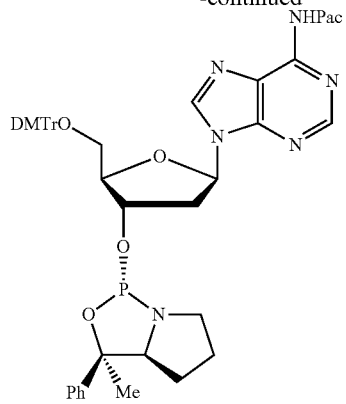 | 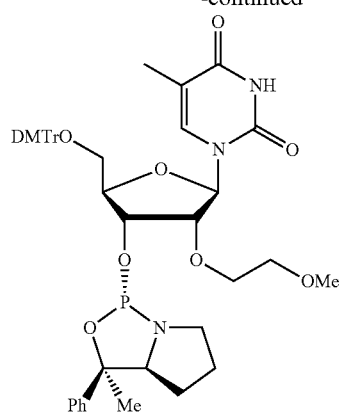 |
| 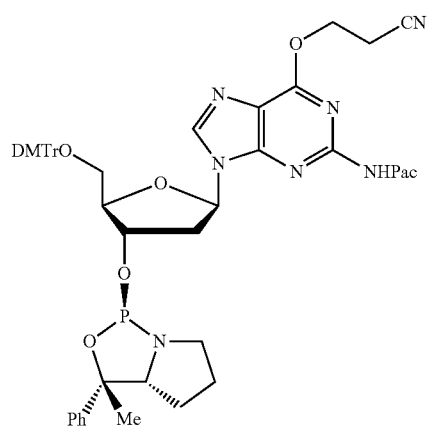 | 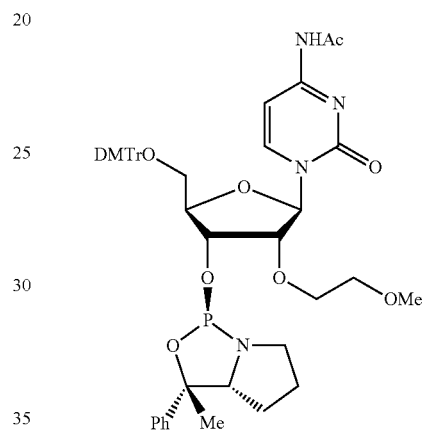 |
| 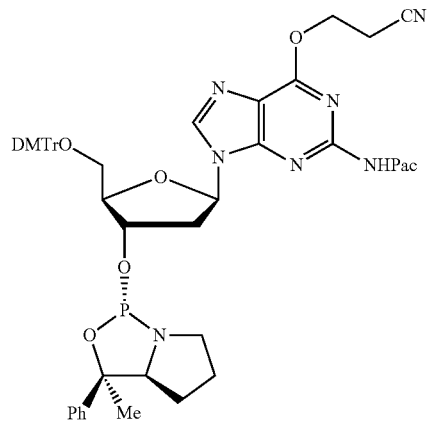 | 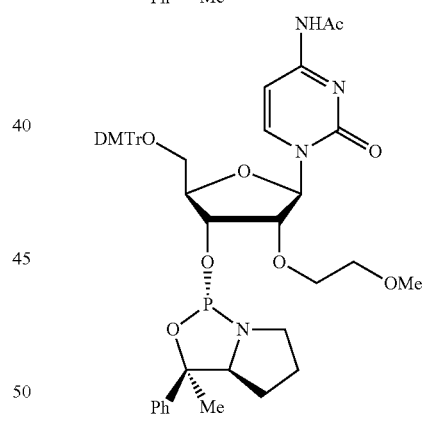 |
| 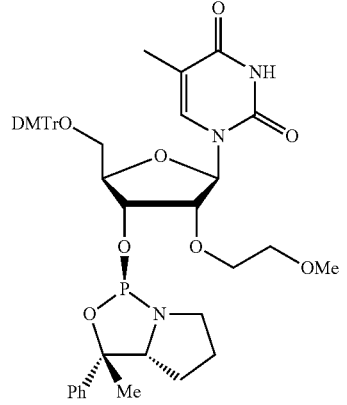 | 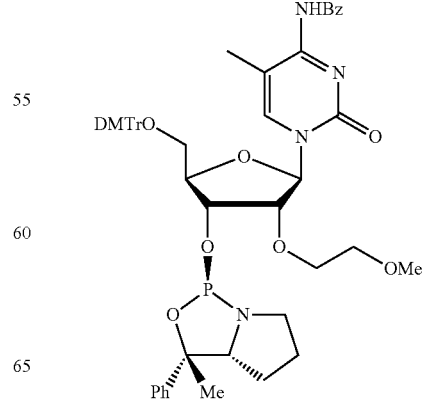 |

371
-continued
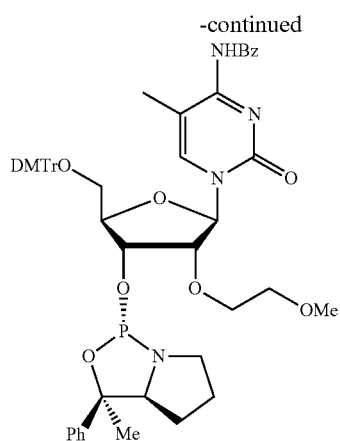
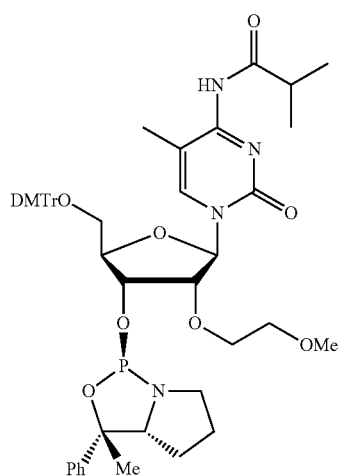
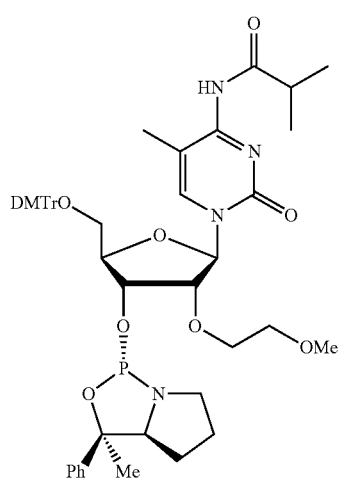
372
-continued
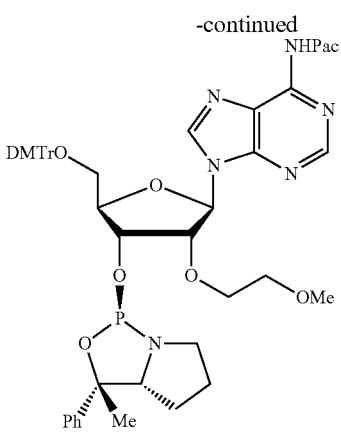
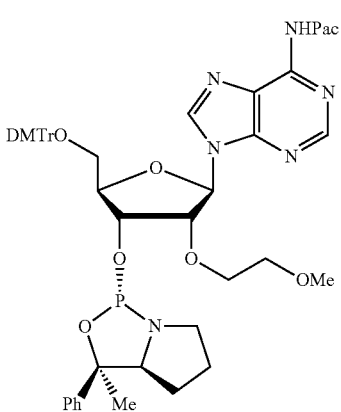
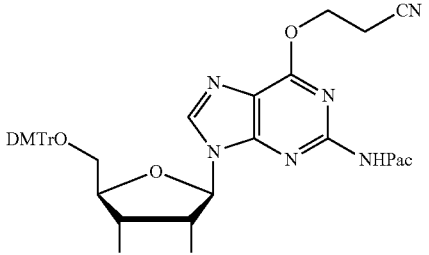
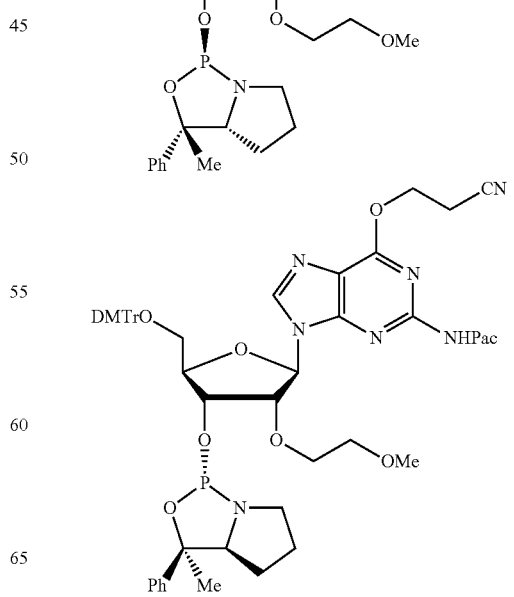

373
-continued
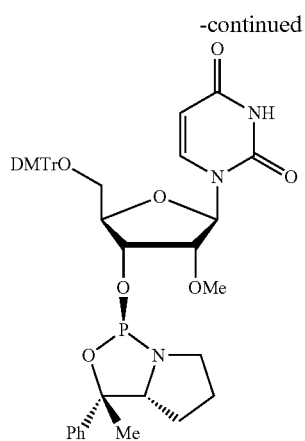
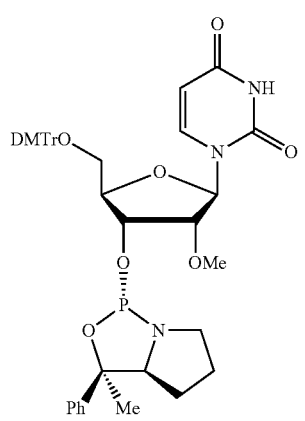
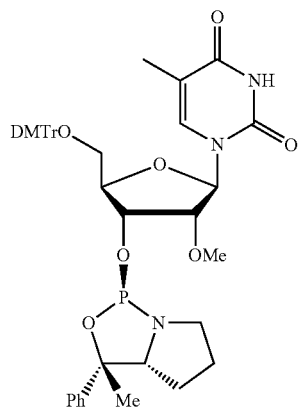
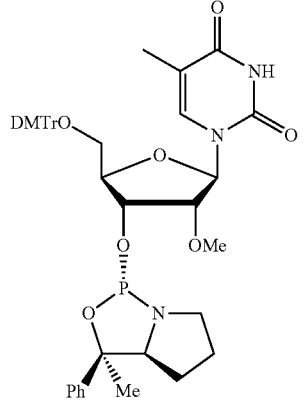
374
-continued
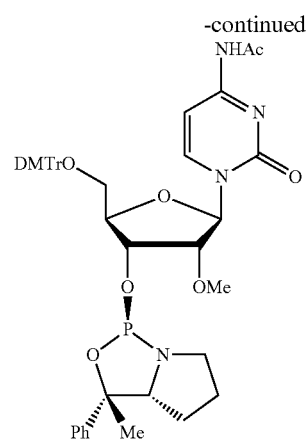
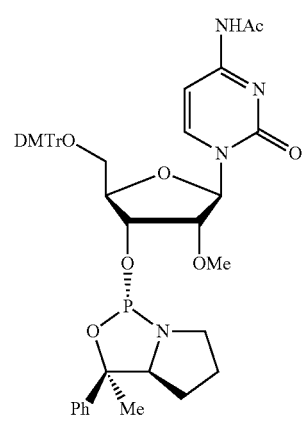
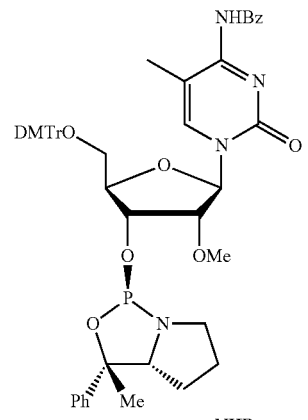
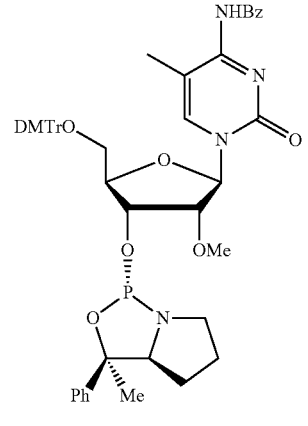

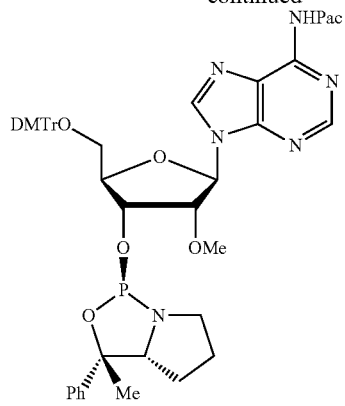
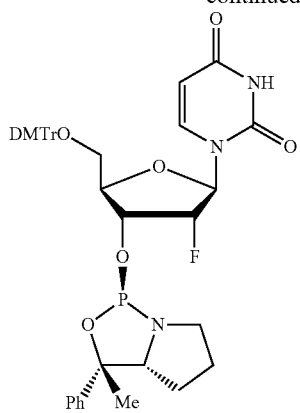
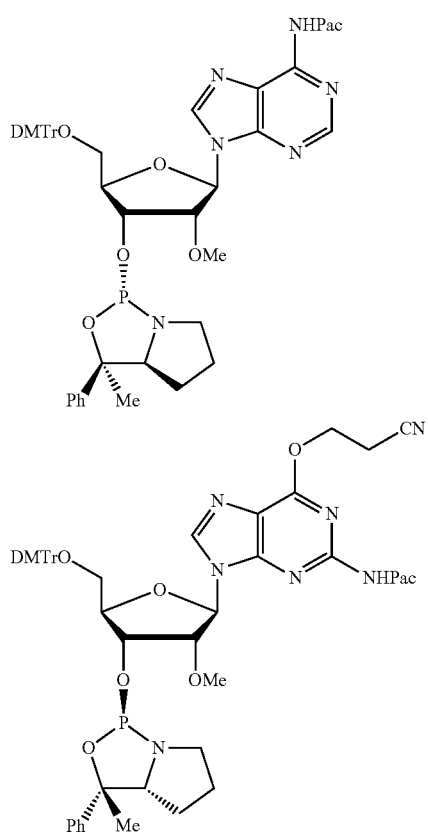
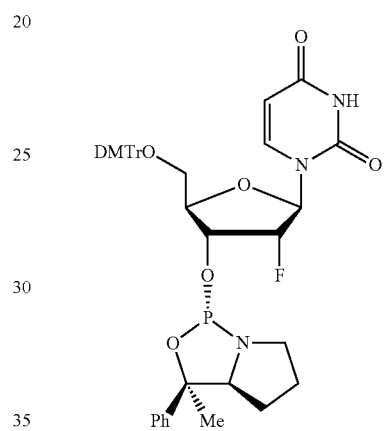
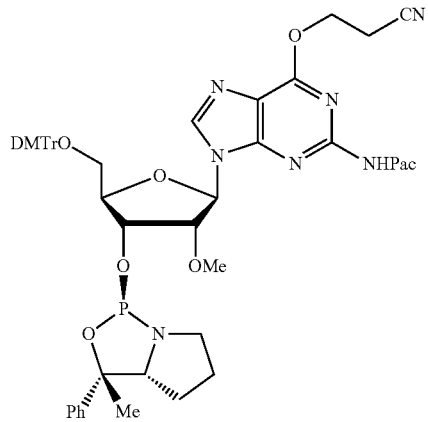
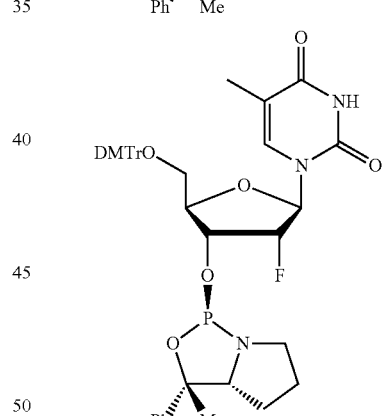
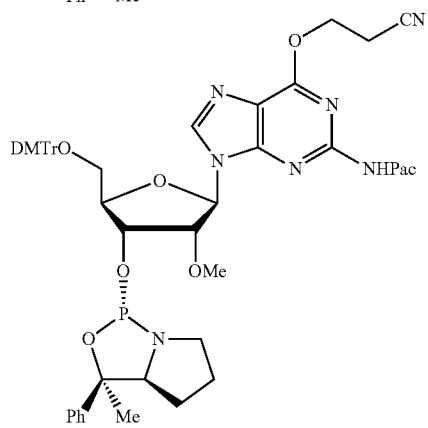
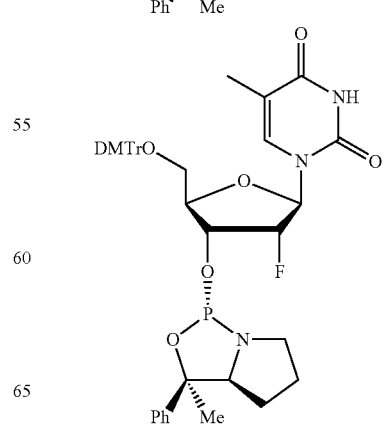

377
-continued
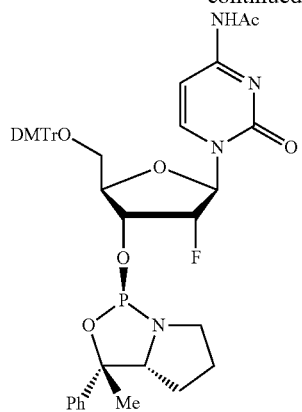
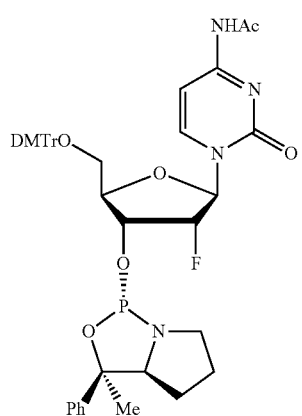
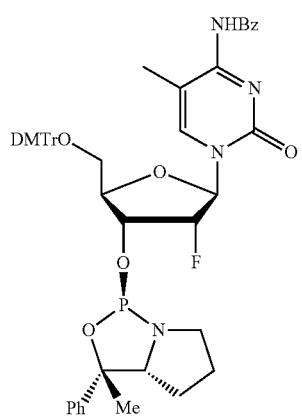
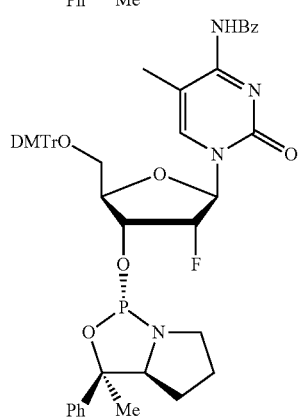
378
-continued
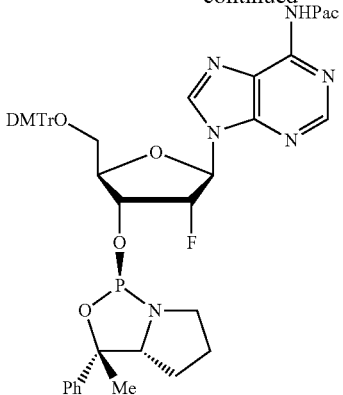
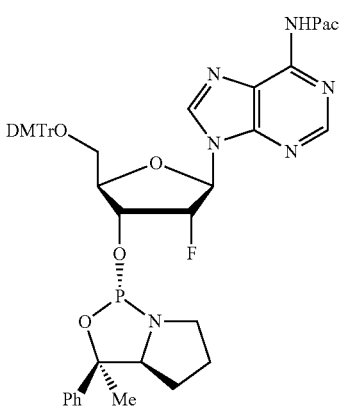
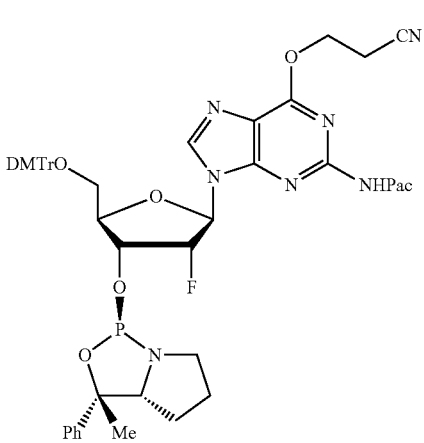
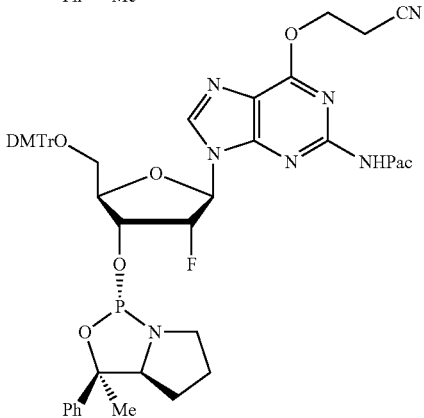

Additional Phosphoramidites:
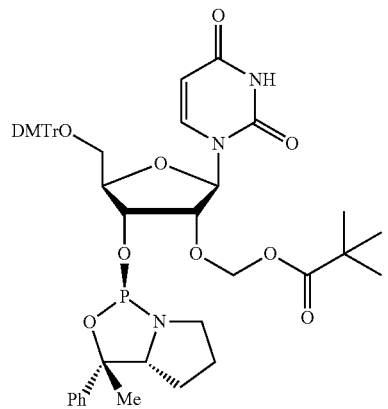
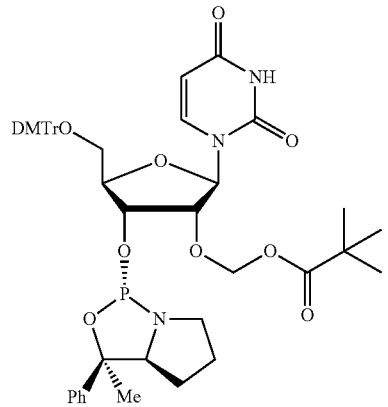
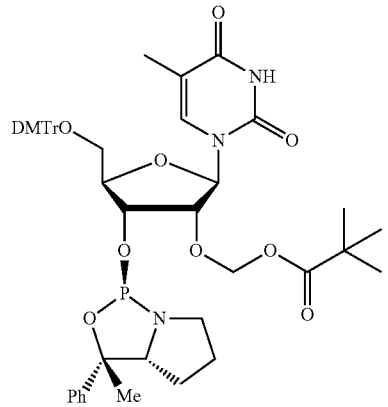
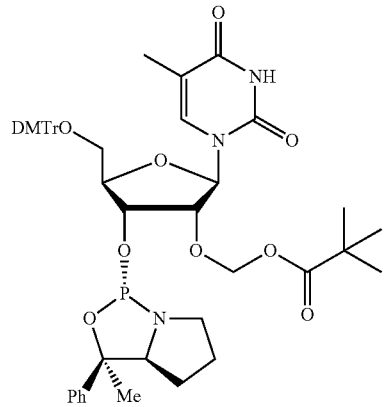
-continued
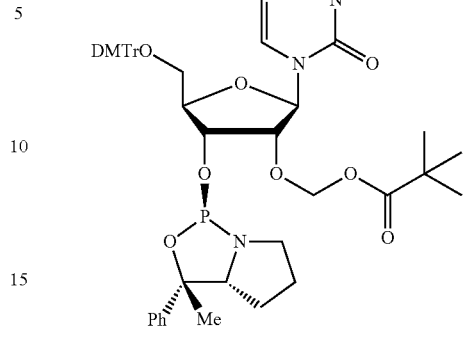
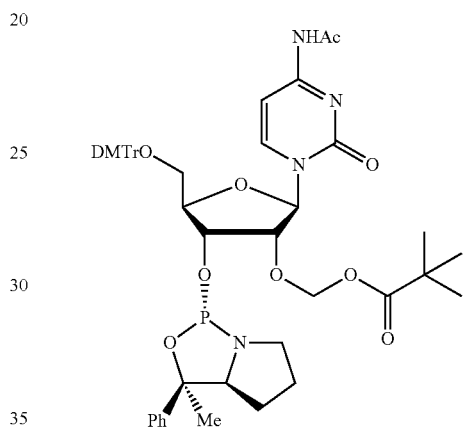
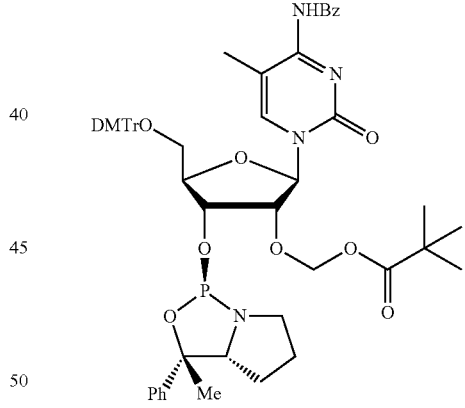
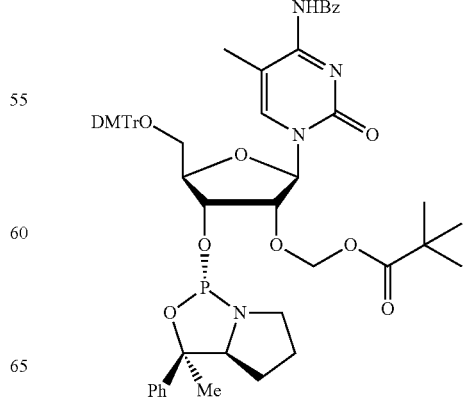

381
-continued
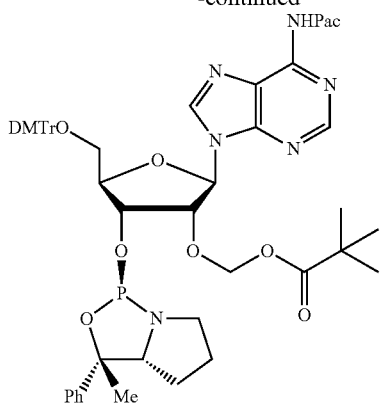
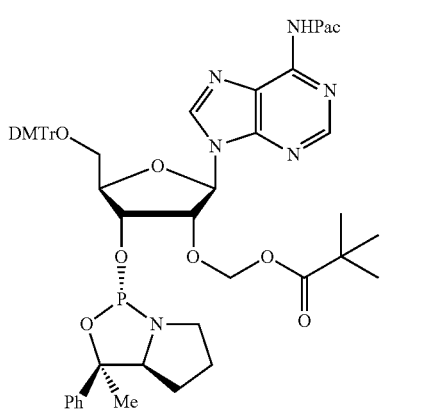
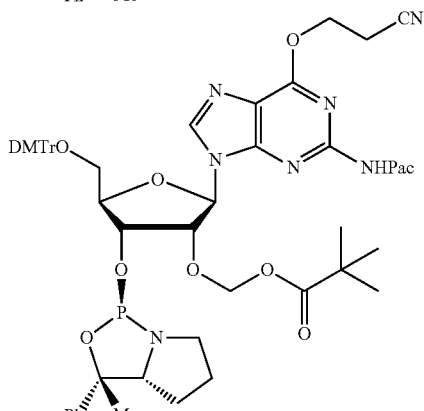
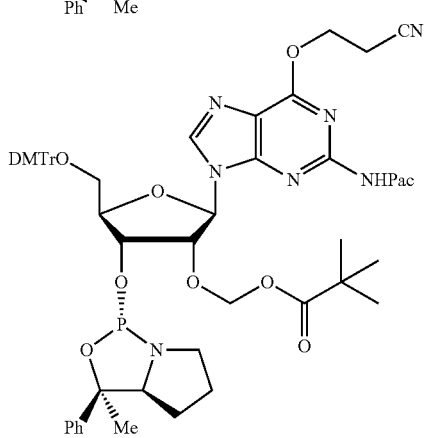
382
-continued
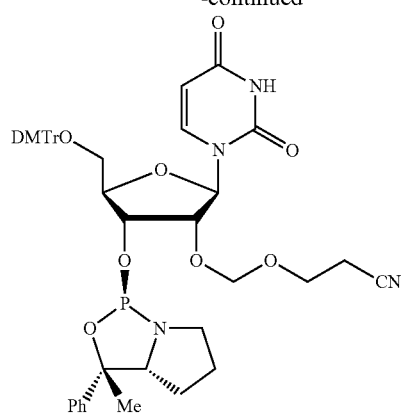
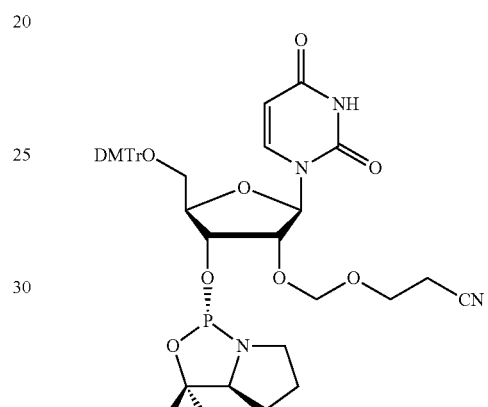
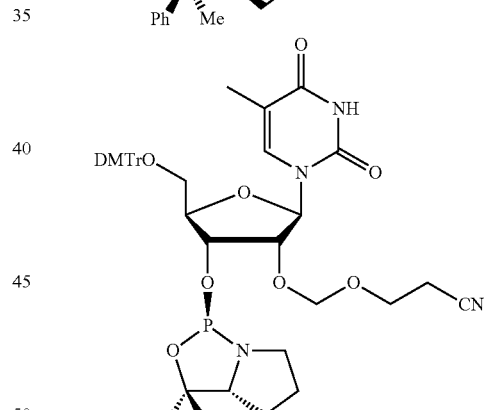
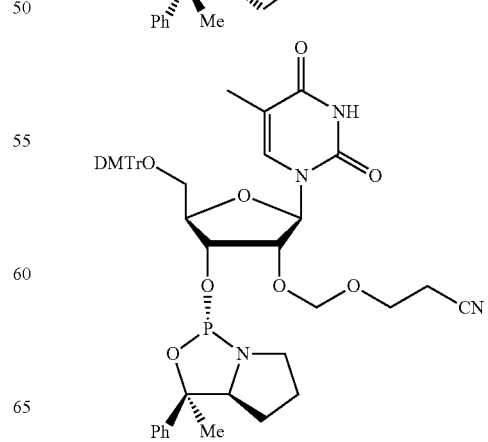

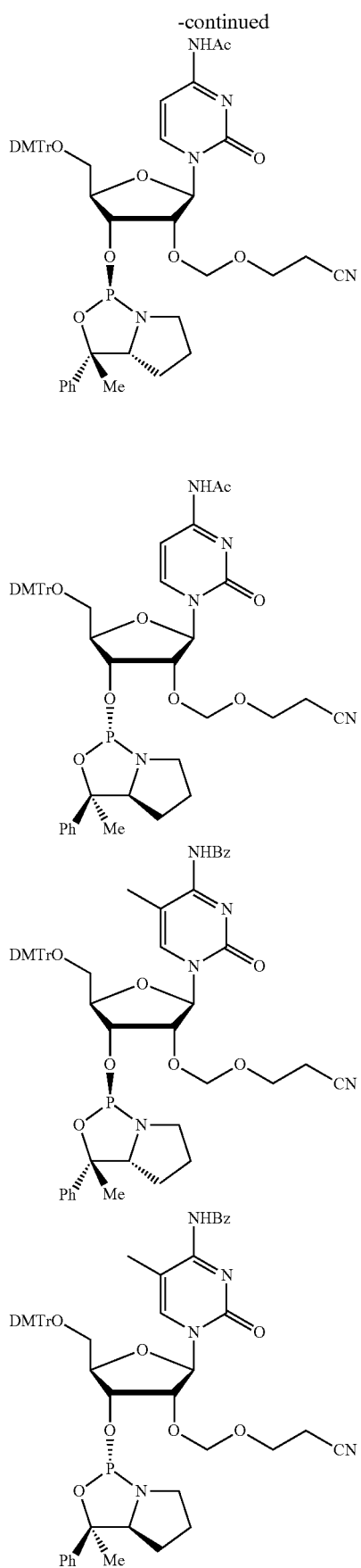
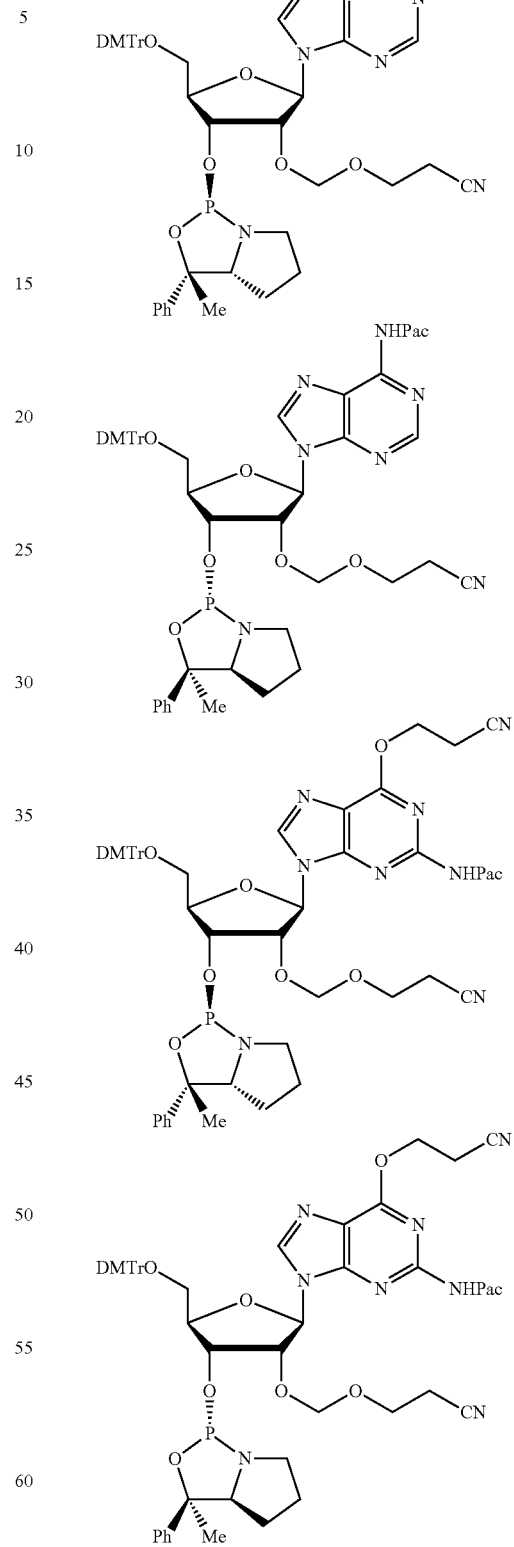
Capping:
In some embodiments, the capping step was carried out in two steps. In some embodiments, the above-mentioned two capping steps were combined into one and performed in one-pot. Unless otherwise specified, the two-step capping was used in the synthesis of the examples described herein.

For the two-step capping, after washing of the solid support with anhydrous ACN and drying by reverse flush with dry argon, the 'Cap A' reagent, typically comprising 5% $Pac_2O$ solution in 2,6-lutidine/THF—1:4 (v/v) was first introduced to the solid support. Without the intention to be limited by theory, Cap A was sufficiently reactive to effectively cap (acylate) the free amine of the chiral auxiliary. In some embodiments, such protection prevents rearrangement/decomposition of the intermediate phosphite. Immediately following this treatment, a 1:1 mixture of 'Cap A' and 'Cap B' reagents was sent to the column containing the solid support. 'Cap B' was a solution of 16% N-methylimidazole (NMI) in THF which, when mixed with 'Cap A' effected capping of, for example, the unreacted 5'-OH oligonucleotide bound to the solid support. Not wishing to be limited by theory, the capping step was extremely important in that, without capping of the amino group of the chiral auxiliary the following sulfurization step within the cycle induced the cleavage of the internucleotidic linkage and decomposition of the oligonucleotide, for instance, due to an undesired intermolecular nucleophilic attack of the free amine of the auxiliary on the phosphorous atom. Moreover, capping of the 5'-OH groups of the run-off uncoupled solid-supported oligonucleotide shortmers is crucial in regards of obtaining high purity of the crude full-length oligonucleotide, avoiding low yields due to accumulation of extended failed sequences and tedious and difficult, if not impossible final purifications.

Sulfurization:

After washing of the solid support with anhydrous ACN and drying by reverse flush with dry argon, the resulting capped phosphite triester intermediate was subject to oxidative sulfurization. A solution of sulfurizing reagent was prepared by mixing the sulfurizing reagent, for example, an alkyl thiosulfonate derivative (300 mM), with N,O-bis(trimethylsilyl)trifluoroacetamide (BSTFA) (100 mM) in ACN. This was then delivered to the column containing the solid support and allowed to react for a certain amount of time (usually 5-60 min). In some embodiments, the sulfurizing thiosulfonate reagent was used as a 300 mM solution in anhydrous ACN, without addition of BSTFA. In some embodiments, the reagent solutions with and without BSTFA produced similar results.

Oxidation:

In some embodiments, oxidation to phosphodiester was performed instead of the sulfurization step. Oxidation was achieved by delivering a solution of 0.02 M $I_2$ in a THF/pyridine/water (70:20:10—v/v/v) co-solvent system, forming a non-chiral phosphodiester linkage.

5'-Deblocking of the DMTr Group:

DMTr removal was effected using 3% TCA in DCM. After de-blocking, the cycle can then be carried forward for further iterative rounds of coupling, capping, sulfurization/oxidation (either sulfurization with the same sulfurizing agent, or sulfurization with a different sulfurizing agent, or oxidation instead of sulfurization, for each of the next cycles) and de-blocking. Alternatively, if the pre-designed length was reached, the oligonucleotide was subject to cycle exit and, optionally, post-synthetic treatment. In some embodiments, the oligonucleotide was removed before de-blocking of the terminal 5'-O-DMTr group.

Spontaneous Removal of Chiral Auxiliary:

The spontaneous removal of chiral auxiliary was achieved during sulfurization, oxidation, de-blocking of the DMTr group, or the combination thereof. No specific step was needed to remove the chiral auxiliary.

Cleavage and Deprotection:

The desired length oligonucleotide was removed from its solid support by cleaving the corresponding linker (oxalyl or succinyl linked HCP or CPG) whilst at the same time, the protecting groups on the oligonucleotide were deprotected. In some embodiments, the solid-supported oligonucleotide was first treated with an anhydrous 1 M solution of 1,5-diazabicyclo(4.3.0)non-5-ene (DBN) or 1,8-diazabicycloundec-7-ene (DBU) in dry ACN-trimethylsilyl chloride—16:1 (v/v) for 10 min at r.t. and then washed with dry ACN, as described by Reese and Yan, *J. Chem. Soc., Perkin Trans.* 1, 2002, 2619. In some embodiments, the material was treated with solutions of dry propylamine in dry pyridine (typically in a 1:4 ratio) for a period of 18 h at r.t. or at 60° C. for 2 h. In some embodiments, either condition afforded the crude compound with similar quality. In some embodiments, the crude oligonucleotides were cleaved from the support and deprotected by treatment with 28% aqueous ammonia for a period of 18 h at r.t. or at 60° C. for 5 h. In some embodiments, either condition afforded the crude compound with similar quality. The solvents were then evaporated and the residue was treated with ~pH 1.5 aqueous solution (the pH may be altered if desired) with 0-50% DMSO, and the crude product was subject to analysis by a combination of HPLC and UPLC/MS. The product was purified by one of or a combination of reverse phase HPLC (RP-HPLC), normal phase HPLC, ion exchange HPLC (IE-HPLC) or size exclusion chromatography. In some embodiments, the oligonucleotide was removed from the solid support, deprotected and purified before de-blocking of the DMTr group.

Example 1: Synthesis of Sulfurizing Reagents and Synthesis of Phosphoramidites

In some embodiments, the present invention provides sulfurizing reagents, and methods of making the same. In some embodiments, the provided sulfurizing reagents were used in the synthesis of oligonucleotides described in the present application. Exemplary sulfurizing reagents and their synthesis are illustrated in Scheme E-1

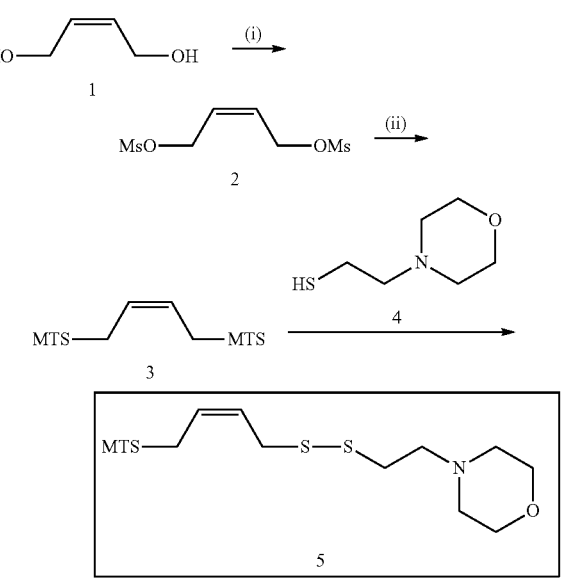

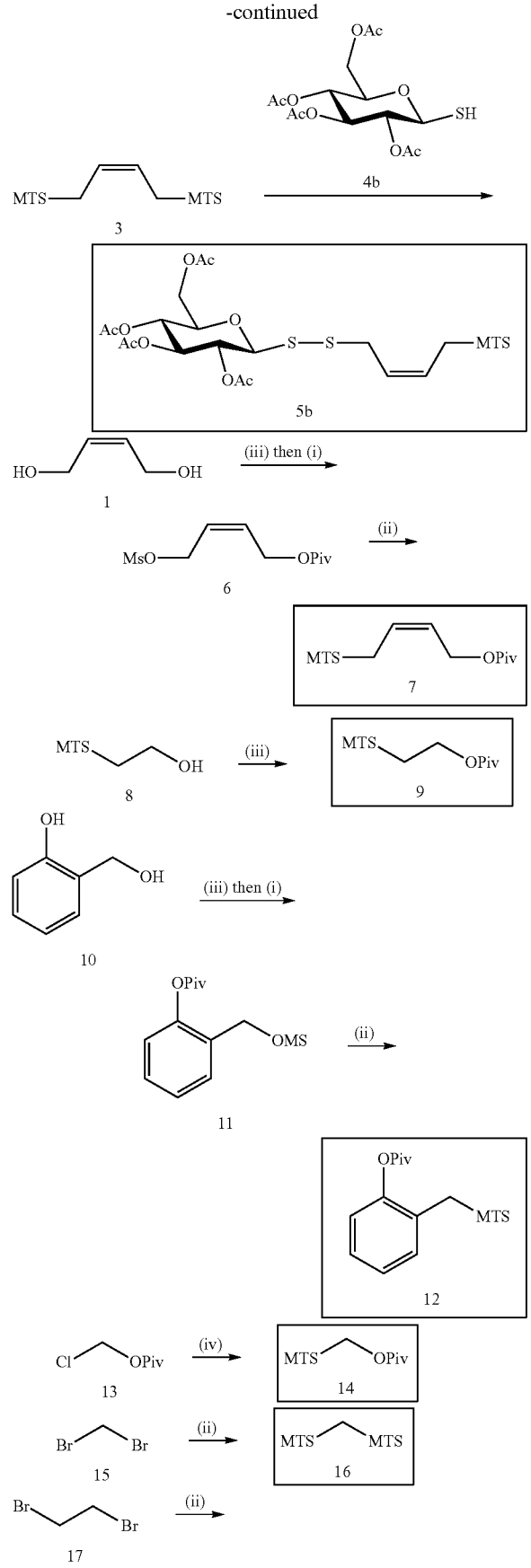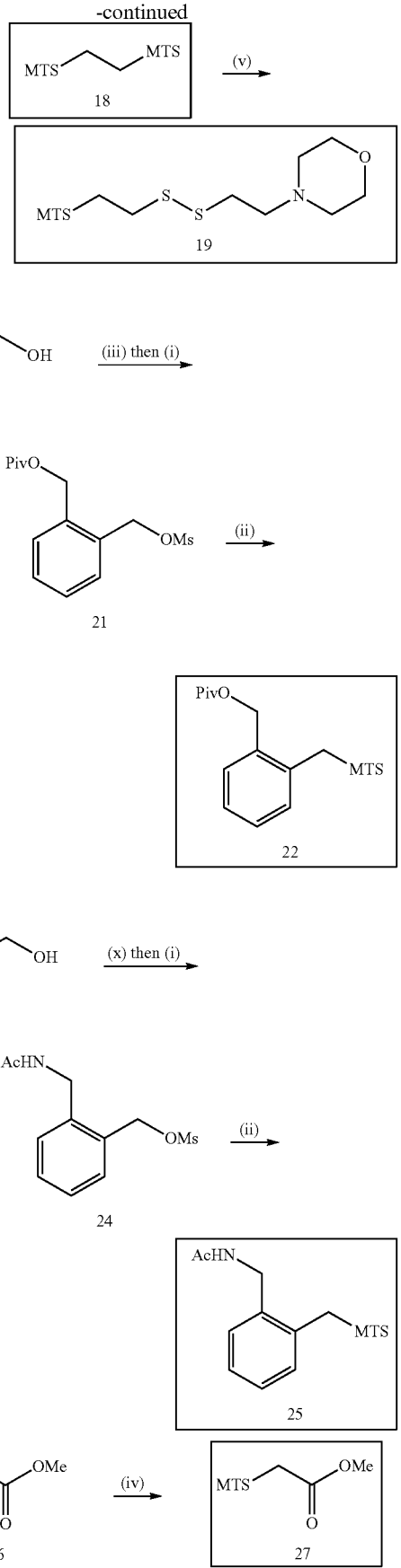

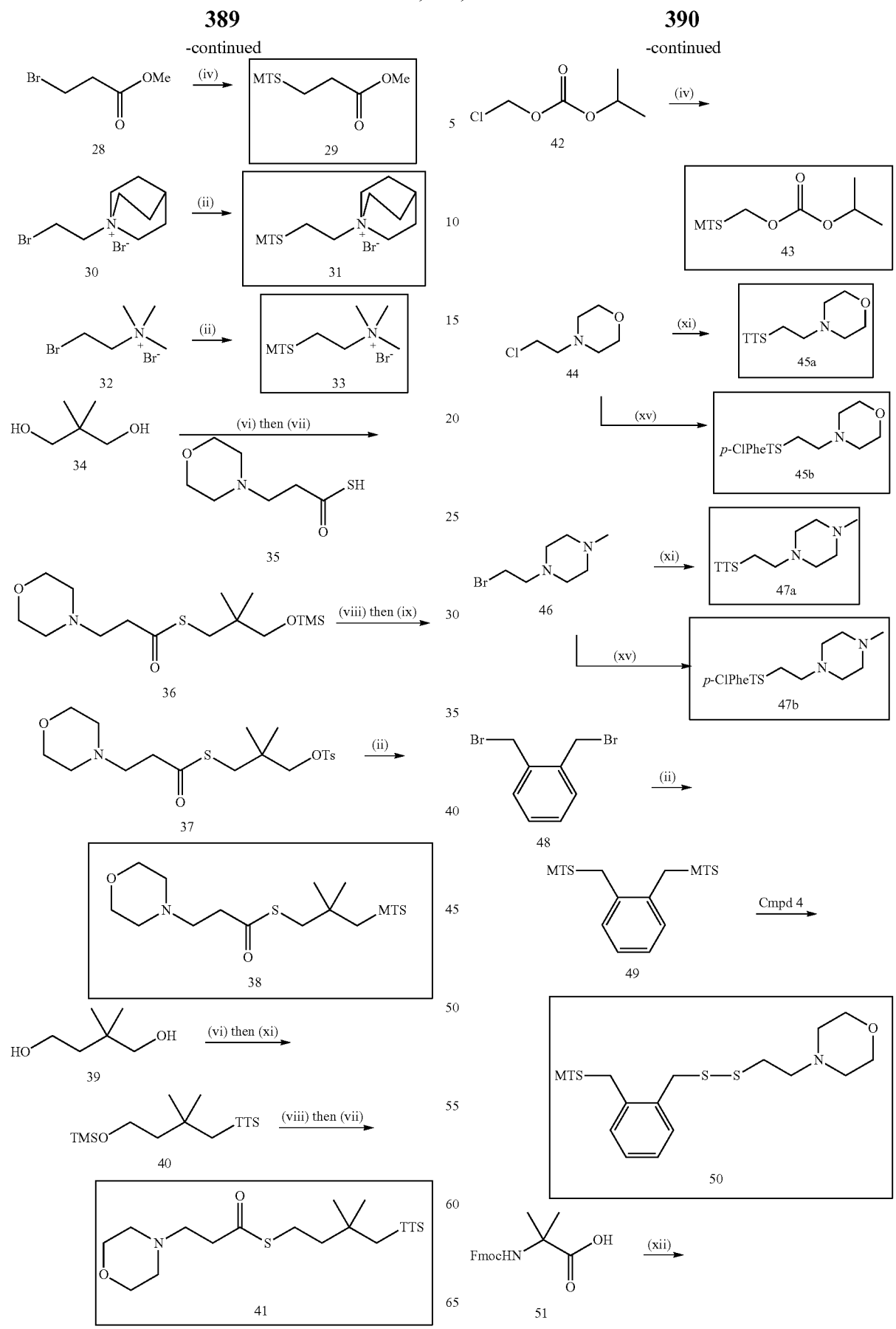

391
-continued
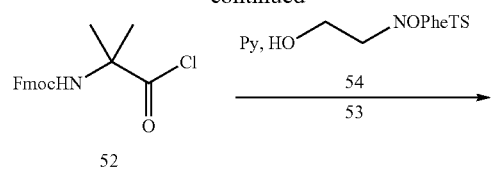
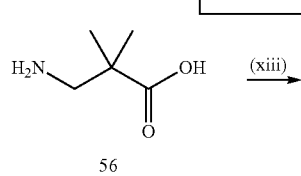
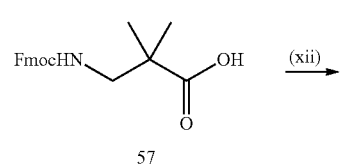
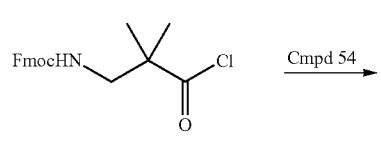
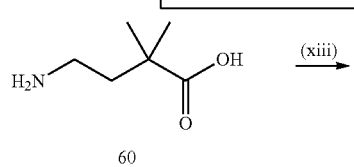
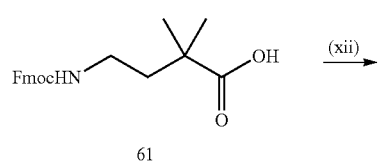
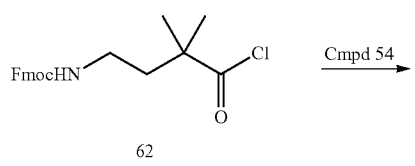
392
-continued
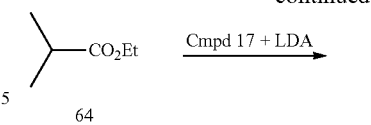
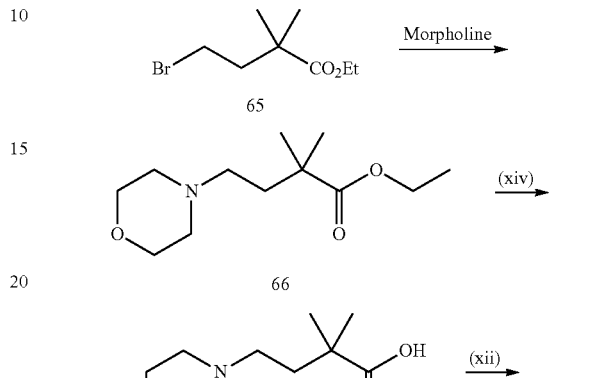
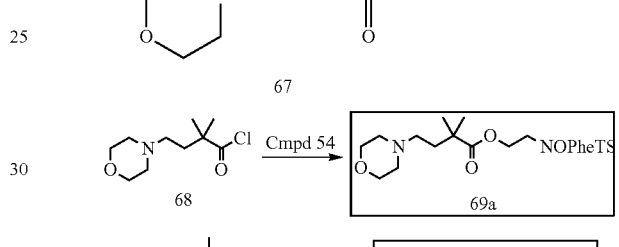
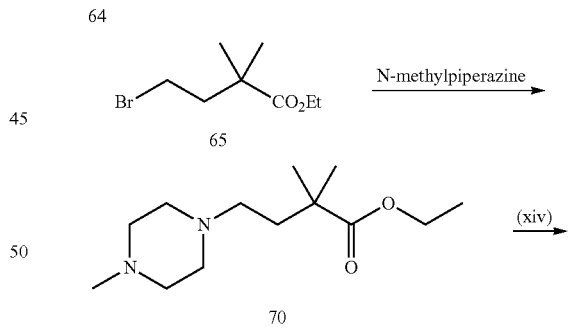
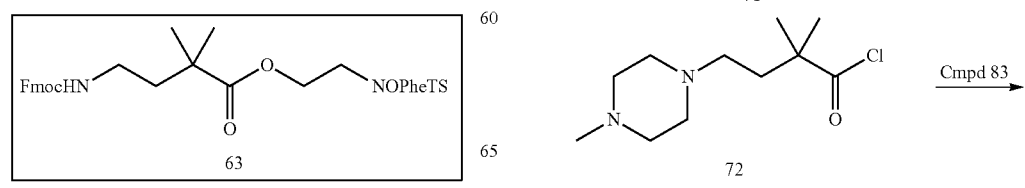

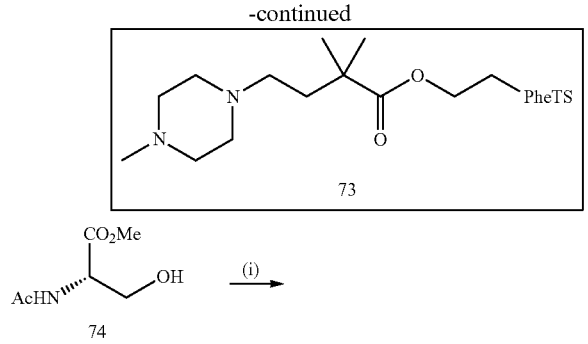
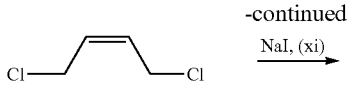
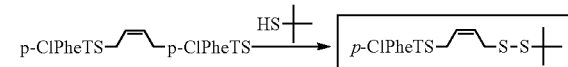
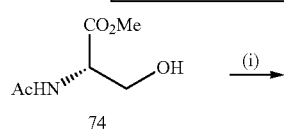
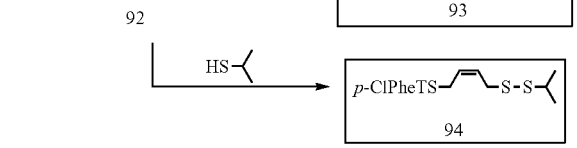
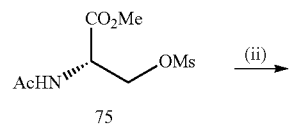
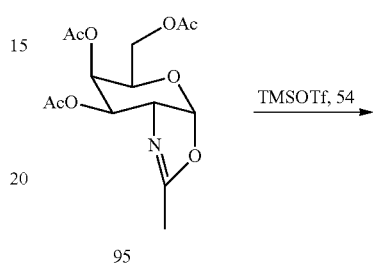
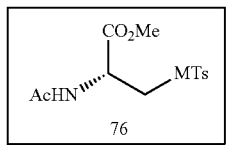
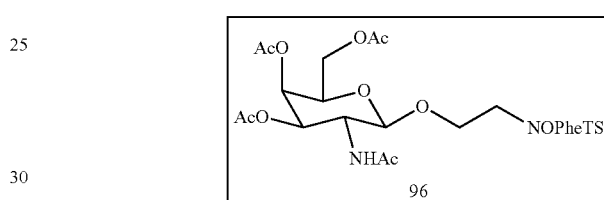
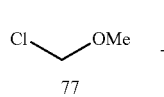
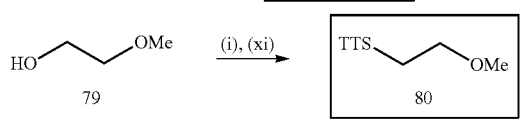
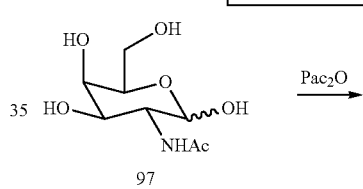
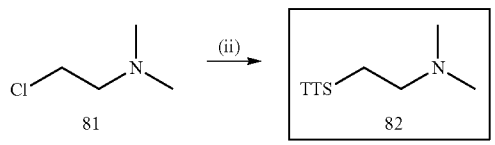
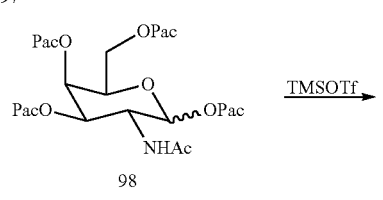
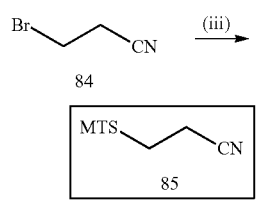
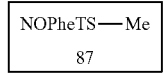
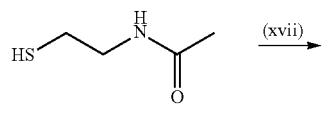
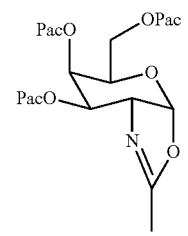
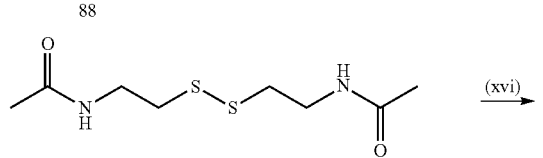
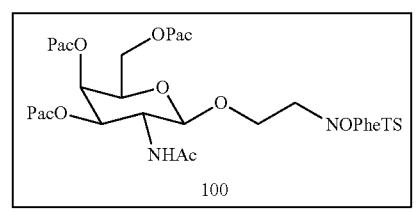
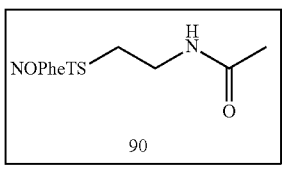

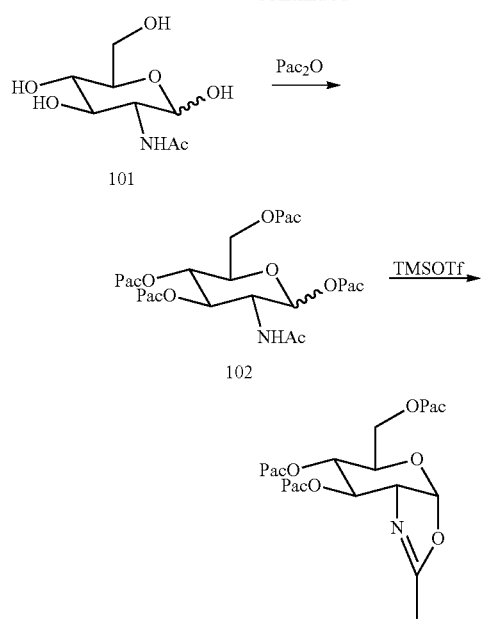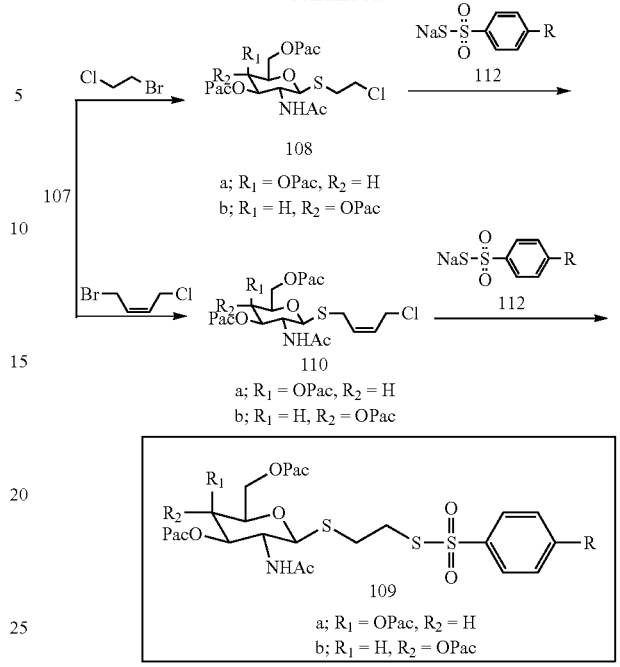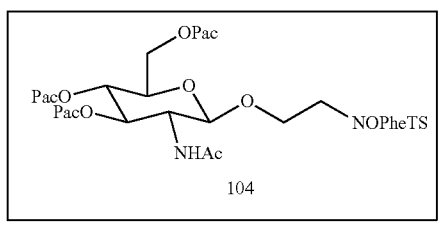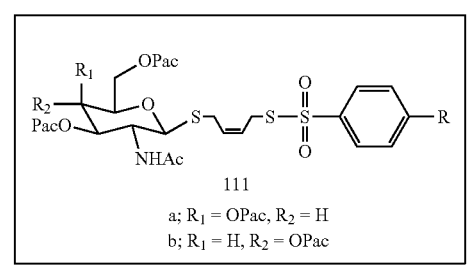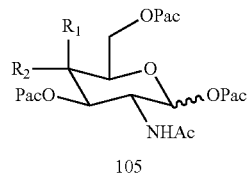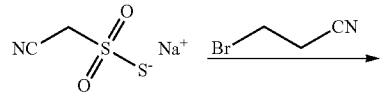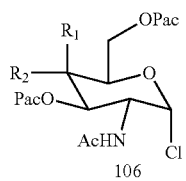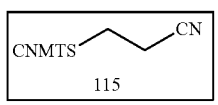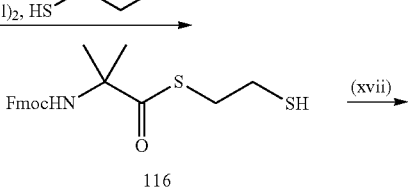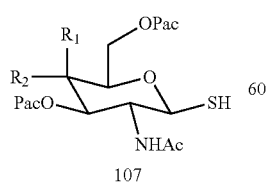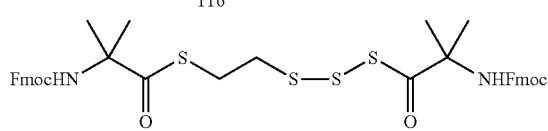

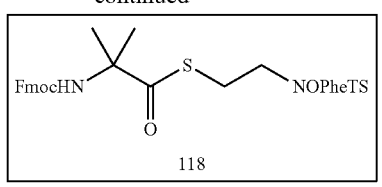
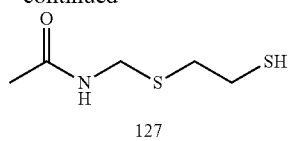
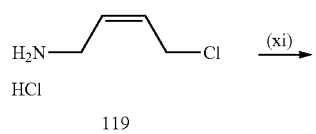
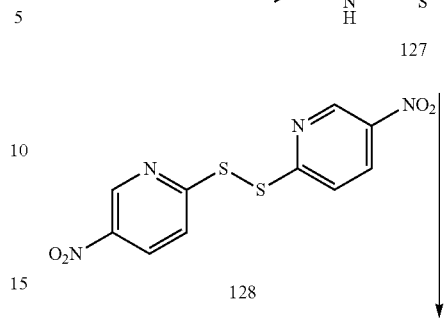
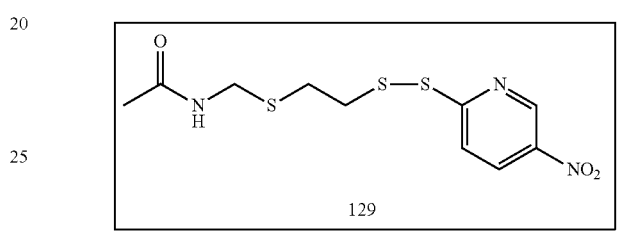
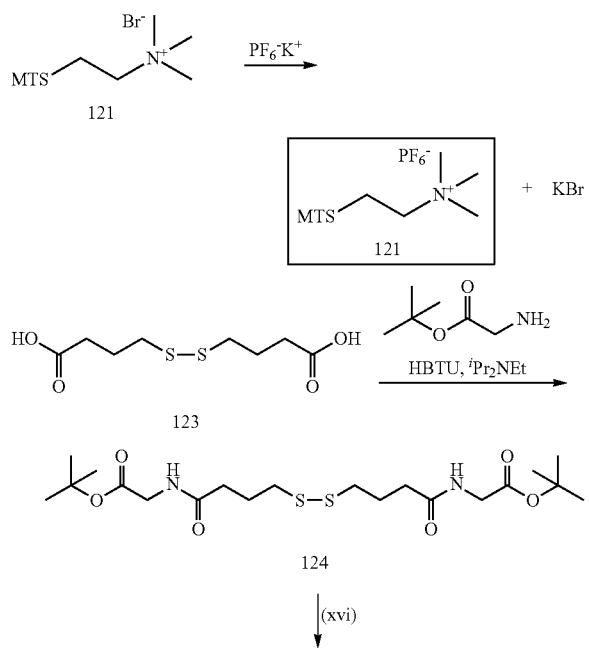
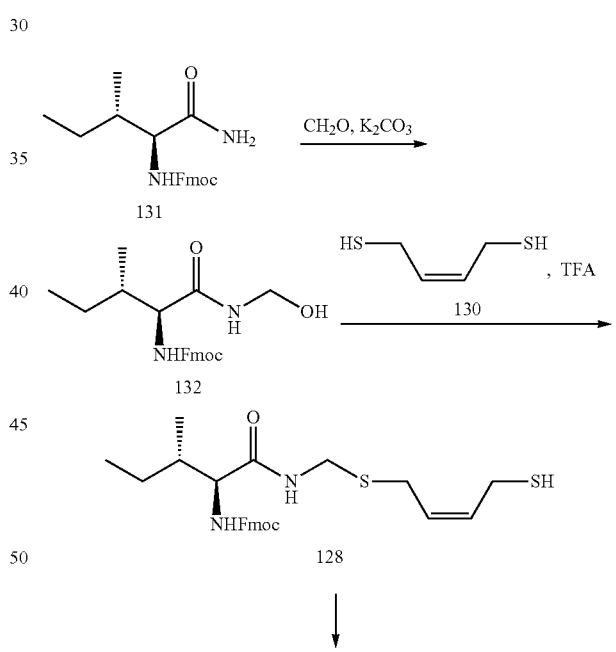
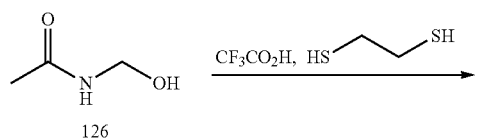

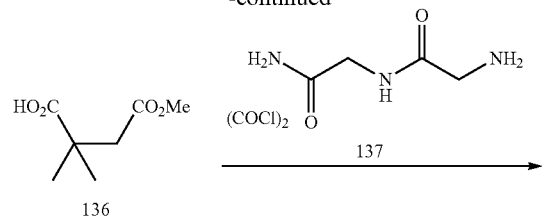
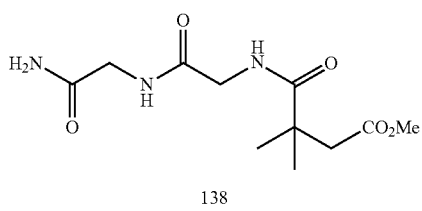
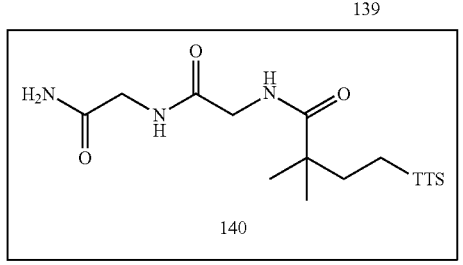
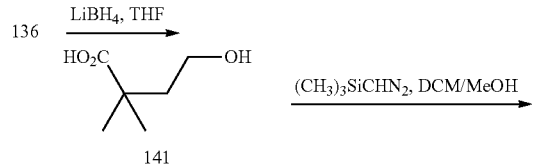
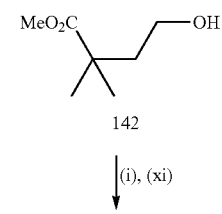
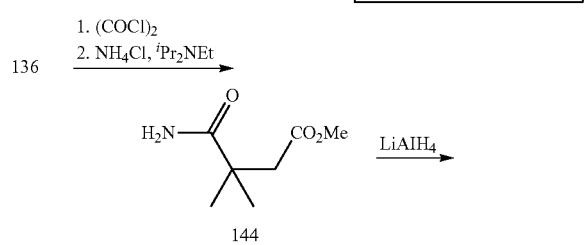
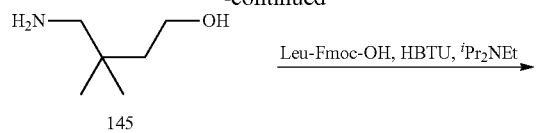
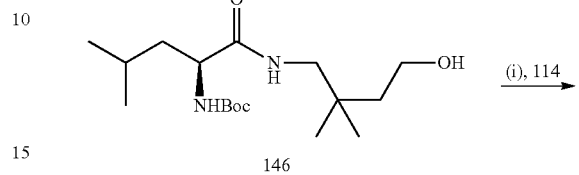
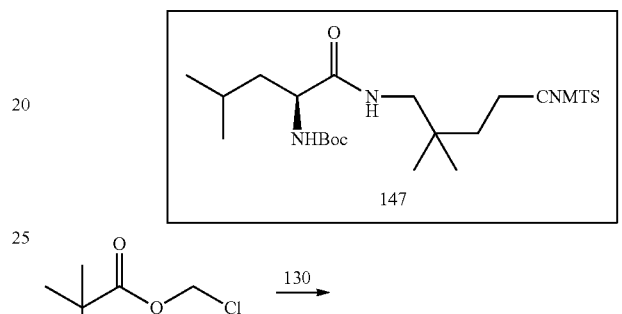
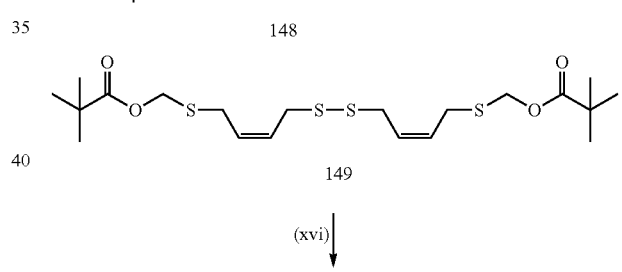
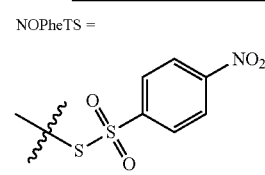
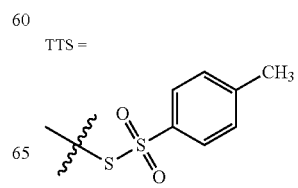

-continued p-ClPheTS =
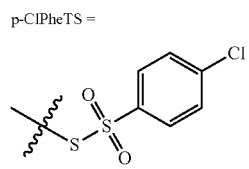

m-ClPheTS =
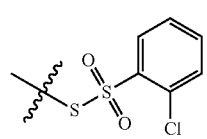

2,4,6-TriClPheTS =
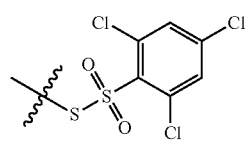

PheTS =
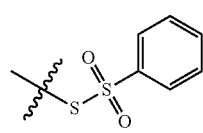

PFPheTS =
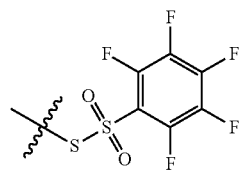

MTS =
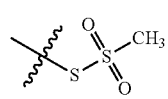

α-CNMTS =
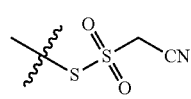

α-NO2MTS =
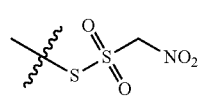

(i) MsCl, NEt₃; (ii) NaMTS; (iii) PivCl, NET₃; (iv) NaMTS, NaI; (v) compound 4; (vi) TMSCl, NEt₃; (vii) compound 35, DEAD, PPh₃; (viii) TBAF; (ix) TsCl, Pyridine; (x) Ac₂O, Pyridine; (xi) KTTS; (xii) (COCl)₂; (xiii) Fmoc-OSu, Py; (xiv) NaOH (aq); (xv) Na-p-ClPheTS; sodium 4-nitrobenzenesulfinate, Br₂; (xvii) H₂O₂, NaI Synthesis of Compound 5

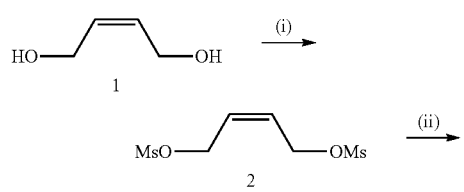

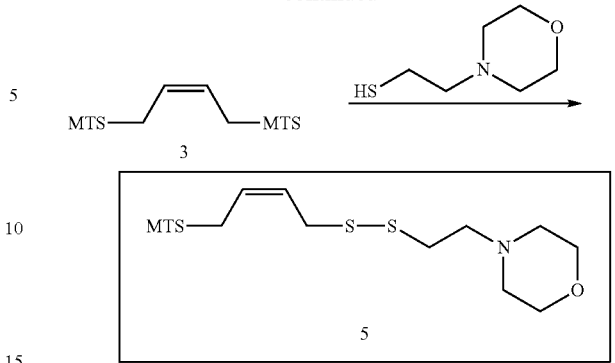

Compound 2:

A solution of (Z)-but-2-ene-1,4-diol (0.93 ml, 11.3 mmol) and triethylamine (3.3 ml, 24 mmol) in dichloromethane (DCM, 50 mL) was added in a dropwise fashion to a stirring ice cold solution of methanesulfonyl chloride (1.9 ml, 24 mmol) in DCM (50 mL). After stirring for 0.5 h at r.t. the mixture was poured onto ice and extracted. The organic layer was collected, dried (MgSO₄) and filtered. After removal of solvent, 2.66 g compound 2 was obtained (96%), which was judged by NMR to be sufficiently pure for direct use in the next step of the reaction. $^1$H NMR (399 MHz, CDCl₃) δ 5.94 (ddd, J=5.4, 4.1, 1.3 Hz, 2H), 4.83 (dd, J—4.1, 1.3 Hz, 4H), 3.04 (s, 6H); $^{13}$C NMR 128.34, 64.38, 38.27; MS (ESI +ve): calc (M+NH₄)⁺: 262.04, found: 262.05; $R_f$=0.3 (1:1 EtOAc/hexane).

Compound 3:

A solution of sodium methanesulfonothioate (1.51 g, 11.3 mmol) in MeOH (20 ml) was treated with neat (Z)-but-2-ene-1,4-diyl dimethanesulfonate (1.25 g, 5.12 mmol) at room temperature. After 5 min, precipitation was observed to occur. After 36 h, the mixture was partitioned between water and DCM. The organic layer was separated, dried (MgSO₄), and filtered. Removal of solvent afforded colorless oil. Column chromatography (ISCO) gave pure compound 3 (0.89 g, 63%) as a colorless oil. $^1$H NMR (399 MHz, CDCl₃) δ 5.84 (ddd, J=6.6, 5.1, 1.5 Hz, 2H), 3.92 (dd, J=5.1, 1.5 HZ, 4H), 3.33 (s, 6H); $^{13}$C NMR 128.1, 51.47, 33.13; MS (ESI +ve): calc (M+NH₄)⁺: 294.00, found: 294.04; $R_f$=0.4 (1:1 EtOAc/hexane).

Compound 4:

Under argon atmosphere, morpholine (10 g, 115 mmol) was added to ethylene sulfide (15 g, 250 mmol) in a round bottom flask. The reaction was stirred for 7 hrs and was directly loaded on to a silica gel column. The column was washed with DCM first and then 2% MeOH/DCM was used to obtain compound 4 (15.3 g, 91%) as colorless oil. $^1$H NMR (399 MHz, CDCl₃) δ 3.67-3.59 (m, 4H), 2.63-2.52 (m, 2H), 2.51-2.45 (m, 2H), 2.44-2.34 (m, 4H); MS (ESI +ve): calc (M+H)⁺=148.07, found: 148.1.

Compound 5:

A DCM solution (1 mL) of 2-morpholinoethanethiol (0.21 g, 1.44 mmol) was added dropwise via syringe to a stirring solution compound 3 (0.40 g, 1.44 mmol) in DCM (10 mL) at room temperature. Immediately after addition, the reaction was checked by TLC, showing rapid formation of the product and some dimer. After 0.5 h, the mixture was partitioned by addition of water. Upon extraction, the organic layer was separated, dried (MgSO₄) and filtered. After removal of solvent in vacuo, column chromatography gave compound 5 (0.29 g, 58%) as colorless oil. $^1$H NMR (399 MHz, CDCl$_3$) δ 5.78 (m, 2H), 3.92 (d, 1=7.3 Hz, 2H), 3.70 (t, 0.1=4.7 Hz, 4H), 3.46 (d, J=5.5 Hz, 2H), 3.31 (s, 3H), 2.84 (dd, J=7.8, 6.7 Hz, 2H), 2.66 (dd, J 7.8, 6.7, 2H), 2.48 (t, J=4.6 Hz, 4H); $^{13}$C NMR 130.35, 126.27, 66.97, 58.20, 53.67, 51.52, 36.22, 35.16, 33.67; MS (ESI +ve): calc (M+H)$^+$: 344.05, found: 344.06; R$_f$=0.3 (EtOAc).

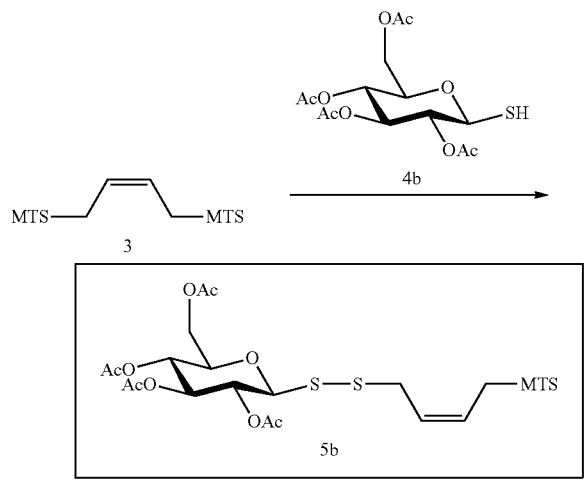

Compound 5b: A DCM solution (1 mL) of compound 4b (395 mg, 1.085 mmol) was added dropwise via syringe to a stirring DCM (15 mL) solution compound 3 (300 mg, 1.085 mmol) at r.t. After 1 h, the resulting solution was partitioned by addition of water. Upon extraction, the organic layer was separated, dried (MgSO$_4$) and filtered. After removal of the solvent in vacuo, column chromatography gave compound 5b as a colorless oil (0.35 g, 58%). $^1$H NMR (399 MHz, CDCl$_3$) δ 5.83-5.70 (m, 2H), 5.35-5.21 (dt, J=26.0, 9.3 Hz, 2H), 5.16-5.07 (m, 1H), 4.59-4.54 (d, J=9.5 Hz, 1H), 4.29-4.23 (m, 1H), 4.23-4.18 (m, 1H), 3.99-3.88 (dd, J=6.7, 1.2 Hz, 2H), 3.80-3.72 (ddd, J=10.1, 4.6, 2.6 Hz, 1H), 3.64-3.56 (m, 1H), 3.50-3.43 (m, 1H), 3.31 (s, 3H), 2.09 (s, 3H), 2.03 (s, 6H), 2.00 (s, 3H); $^{13}$C NMR (100 MHz, CDCl$_3$) δ 170.68, 170.30, 169.51, 169.30, 129.43, 127.14, 87.73, 76.49, 73.89, 69.16, 67.99, 61.99, 51.64, 35.89, 33.58, 20.95, 20.80, 20.74, 20.71; MS (ESI +ve): calc (M+NH$_4$)$^+$: 578.07, found: 577.96; R$_f$=0.5 (1:1 EtOAc/hexane).
Synthesis of Compound 7

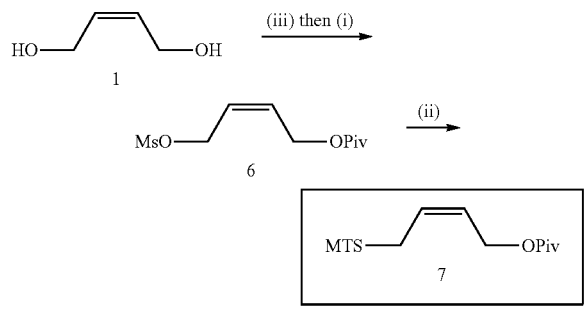

Compound 6: An ice cold solution of (Z)-but-2-ene-1,4-diol (0.93 ml, 11.3 mmol) and triethylamine (1.6 mL, 11.5 mmol) in DCM (50 ml) was treated dropwise via syringe with pivaloyl chloride (1.4 ml, 11.4 mmol) over 2 min. After 1 h, TLC showed good reaction results. The resulting mixture was partitioned by addition of water. Upon extraction, the organic layer was separated, dried (MgSO$_4$), and concentrated in vacuo. This crude compound was found: by TLC (Rf=0.6, 1:1 EtOAc/hexane) to contain no starting diol and was used crude to prepare the mesylate. The crude material was taken up in DCM (50 ml) containing triethylamine (1.7 mL, 12 mmol) and cooled on an ice bath. Methanesulfonyl chloride (0.98 ml, 12.66 mmol) was added dropwise via syringe over 2 min. TLC immediately after addition indicated complete consumption of starting material. The resulting mixture was partitioned by addition of water. Upon extraction, the organic layer was separated, dried (MgSO$_4$), filtered and concentrated in vacuo. Column chromatography gave pure compound 6, 1.48 g, 52%, as a colorless oil. $^1$H NMR (399 MHz, CDCl$_3$) δ 5.89-5.75 (m, 2H), 4.89-4.84 (d, J=5.7 Hz, 2H), 4.68-4.63 (d, J=5.9 Hz, 2H), 3.03 (s, 3H), 1.19 (s, 9H); $^{13}$C NMR (100 MHz, CDCl$_3$) δ 178.28, 130.61, 126.11, 65.08, 59.65, 38.84, 38.21, 27.25; MS (ESI +ve): calc (M+NH$_4$)$^+$: 268.12, found: 268.20; R$_f$=0.3 (20% EtOAc/hexane).

Compound 7:
A MeOH (10 ml) solution of sodium methanesulfonothioate (0.63 g, 4.70 mmol) and (Z)-4-(methylsulfonyloxy)but-2-enyl pivalate (1.00 g, 4.00 mmol) was stirred at r.t. for 18 h with formation of a white precipitate (after 10 min). The resulting mixture was partitioned by addition of water and DCM. Upon extraction into DCM, the organic layer was separated, dried (MgSO4), filtered and concentrated in vacuo. Column chromatography gave compound 7, 0.83 g, 78% as a colorless oil. $^1$H NMR (399 MHz, CDCl$_3$) δ 5.82-5.73 (m, 2H), 4.73-4.66 (m, 2H), 3.95-3.87 (m, 2H), 3.32 (s, 3H), 1.19 (s, 9H); $^{13}$C NMR (100 MHz, CDCl$_3$) δ 178.35, 129.37, 127.32, 59.50, 51.44, 38.84, 33.61, 27.28; MS (ESI +ve): calc (M+NH$_4$)$^+$: 284.10, found: 284.19; R$_f$=0.4 (20% EtOAc/hexane).
Synthesis of Compound 9

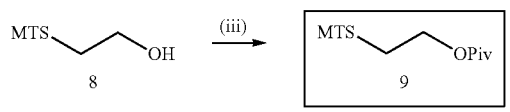

Compound 9:
Pivaloyl chloride (0.60 g, 5.0 mmol) was added in a dropwise fashion to a stirring solution of S-2-hydroxyethyl methanesulfonothioate (0.65 g, 4.16 mmol) in DCM (20 ml). After 2 h at r.t. the resulting mixture with white precipitate was partitioned with water. The organic layer was separated, dried (Na$_2$SO$_4$), filtered concentrated to an oil. Column chromatography gave compound 9 as a colorless oil (0.45 g, 45%). $^1$H NMR (399 MHz, CDCl$_3$) δ 4.39-4.34 (t, J=6.3 Hz, 2H), 3.44-3.39 (t, J=6.3 Hz, 2H), 3.36 (s, 3H), 1.20 (s, 9H); $^{13}$C NMR (100 MHz, CDCl$_3$) δ 62.10, 51.11, 38.96, 35.19, 27.24; MS (ESI +ve): calc (M+NH$_4$)$^+$: 158.08, found: 158.04; R$_f$=0.3 (20% EtOAc/hexane).
Synthesis of Compound 12

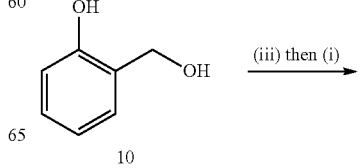

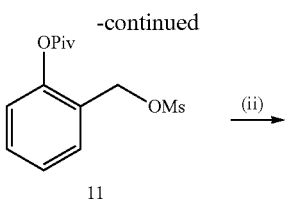

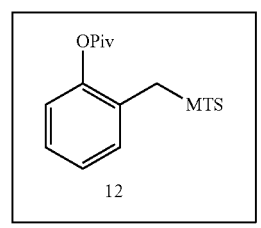

Compound 11:

Pivaloyl chloride (4.96 ml, 40.3 mmol) was added dropwise via syringe to an ice cold DCM solution (50 mL) of 2-(hydroxymethyl)phenol (5 g, 40.3 mmol) and triethylamine (5.61 ml, 40.3 mmol). An ice-cold solution of the crude pivalate ester was treated with triethylamine (6.74 ml, 48.4 mmol) and 50 mL DCM. Methanesulfonyl chloride (3.43 ml, 44.3 mmol) was then added slowly (5 min) via syringe and the resulting mixture was warmed to r.t. The mixture was poured onto ice and the organic layer was separated then washed with sat NaHCO$_3$ (aq), dried (MgSO$_4$), filtered and concentrated to afford 10.5 g crude pale yellow oil. Column chromatography (ISCO) gave pure 11 5.45 g, 47%. $^1$H NMR (399 MHz, CDCl$_3$) δ 7.53-7.46 (dd, 7.7, 1.8 Hz, 1H), 7.46-7.40 (dt, 7.7, 1.8 Hz, 1H), 7.32-7.24 (t, 7.7 Hz, 1H), 7.13-7.06 (d, 7.7 Hz, 1H), 5.21 (s, 2H), 2.79 (s, 3H), 1.40 (s, 9H); $^{13}$C NMR (100 MHz, CDCl$_3$) δ 177.05, 150.06, 131.18, 131.07, 126.35, 125.94, 123.21, 66.88, 39.48, 38.82, 27.30, 27.26. MS (ESI +ve): calc (M+NH$_4$)$^+$: 304.12, found: 303.99; R$_f$=0.4 (20% EtOAc/hexane).

Compound 12:

A MeOH (20 mL) solution of sodium methanesulfonothioate (0.825 g, 6.15 mmol) was treated with 2-((methylsulfonyloxy)methyl)phenyl pivalate (1.76 g, 6.15 mmol) at r.t. and left to stir for 18 h. The mixture was partitioned between water and DCM. The organic layer was separated, dried (MgSO$_4$), filtered and concentrated to afford a colorless oil. Column chromatography gave pure compound 12 as a pale colorless oil, 0.754 g, 41%. $^1$H NMR (399 MHz, CDCl$_3$) δ 7.48-7.44 (dd, J=7.7, 1.7 Hz, 1H), 7.39-7.34 (td, J=7.8, 1.7 Hz, 1H), 7.25-7.20 (td, J=7.6, 1.2 Hz, 1H), 7.10-7.06 (dd, J 8.2, 1.2 Hz, 1H), 4.29 (s, 2H), 2.90 (s, 3H), 1.39 (s, 9H); $^{13}$C NMR (100 MHz, CDCl$_3$) δ 176.69, 149.59, 131.17, 129.85, 127.41, 126.18, 123.40, 51.43, 39.47, 36.01, 27.30; MS (ESI +ve): calc (M+NH$_4$)$^+$: 320.10, found: 320.09; R$_f$=0.4 (20% EtOAc/hexane).

Synthesis of Compound 14

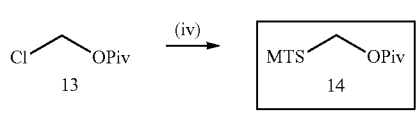

Compound 14:

Chloromethyl pivalate (0.478 ml, 3.32 mmol) was added to a stirring mixture of sodium iodide (0.050 g, 0.33 mmol) and sodium methanesulfonothioate (0.445 g, 3.32 mmol) in acetone (7 ml) at r.t. After 24 h, TLC showed good conversion to product. The solvent was removed, and the residue was partitioned between water and DCM. The organic layer was separated and dried (MgSO$_4$), filtered and concentrated to afford a colorless oil. Column chromatography gave pure 14 as a slightly pink solid, 0.41 g, 55%. $^1$H NMR (399 MHz, CDCl$_3$) δ 5.67 (s, 2H), 3.39 (s, 3H), 1.24 (s, 9H); $^{13}$C NMR (100 MHz, CDCl$_3$) δ 177.35, 67.84, 52.20, 38.93, 27.05; R$_f$=0.5 (20% EtOAc/hexane).

Synthesis of Compound 16

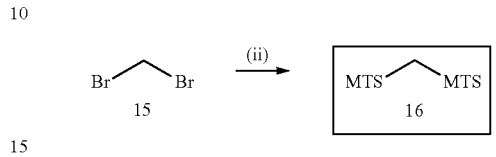

Compound 16:

Prepared from 15 and NaMTS as described previously in U.S. Pat. No. 3,484,473. $^1$H NMR (399 MHz, CDCl$_3$) δ 4.86 (s, 2H), 3.45 (s, 6H); $^{13}$C NMR (100 MHz, CDCl$_3$) δ 52.15, 41.50.

Synthesis of Compounds 18 and 19

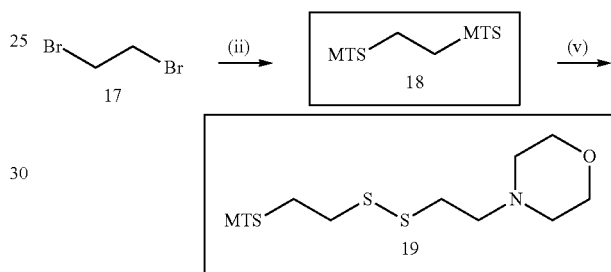

Compound 18:

Prepared from 17 and NaMTS as described previously: Chem. Pharm. Bull. Vol. 12(11) p. 1271, 1964. $^1$H NMR (399 MHz, CDCl$_3$) δ 3.55 (s, 4H), 3.40 (s, 6H); $^{13}$C NMR (100 MHz, CDCl$_3$) δ 50.67, 35.96.

Compound 19:

A DCM solution (1 mL) of 2-morpholinoethanethiol (0.17 g, 1.2 mmol) was added dropwise via syringe to a stirring solution of compound 18 (300 mg, 1.2 mmol) in DCM (10 mL) at r.t. Immediately after addition, TLC showed rapid formation of product and some dimer. After 0.5 h, the mixture was partitioned by addition of NaHCO$_3$ solution. Upon extraction, the organic layer was separated, dried (MgSO$_4$), filtered and concentrated in vacuo. Column chromatography gave pure 19 (0.20 g, 53%) as a colorless oil. $^1$H NMR (399 MHz, CDCl$_3$) δ 3.73-3.67 (t, J=4.7 Hz, 4H), 3.51-3.46 (m, 2H), 3.35 (s, 3H), 3.07-3.01 (m, 2H), 2.88-2.83 (m, 2H), 2.69-2.63 (m, 2H), 2.52-2.43 (t, J=4.6 Hz, 4H); $^{13}$C NMR (100 MHz, CDCl$_3$) δ 66.96, 57.91, 53.58, 50.79, 37.66, 36.10, 35.52; MS (ESI +ve): calc (M+H)$^+$: 318.03, found: 318.04; R$_f$=0.3 (EtOAc).

Synthesis of Compound 22

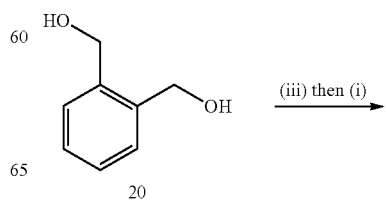

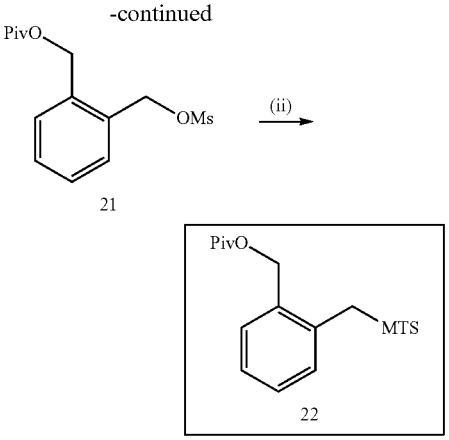

Compound 21:

Compound 20 was converted to compound 21 by a procedure analogous to that described for compound 11. $^1$H NMR (399 MHz, CDCl$_3$) δ 7.45-7.36 (m, 4H), 5.37 (s, 2H), 5.21 (s, 2H), 2.93 (s, 3H), 1.21 (s, 9H); $^{13}$C NMR (100 MHz, CDCl$_3$) δ 178.20, 135.65, 131.92, 130.48, 129.98, 129.78, 128.88, 69.05, 63.39, 38.94, 38.36, 27.27; MS (ESI +ve): calc (M+NH$_4$)$^+$: 318.24, found: 318.14; R$_f$=0.4 (20% EtOAc/hexane).

Compound 22:

Compound 21 was converted to compound 22 by a procedure analogous to that described for compound 12. $^1$H NMR (399 MHz, CDCl$_3$) δ 7.46-7.32, (m, 4H), 5.21 (s, 2H), 4.50 (s, 2H), 3.03 (s, 3H), 1.21 (s, 9H); $^{13}$C NMR (100 MHz, CDCl$_3$) δ 178.24, 135.10, 133.15, 130.93, 130.32, 129.05, 129.00, 63.61, 51.07, 38.97, 38.03, 27.30; MS (ESI +ve): calc (M+NH$_4$)$^+$: 334.11, found: 334.13; R$_f$=0.4 (20% EtOAc/hexane).

Synthesis of Compound 25

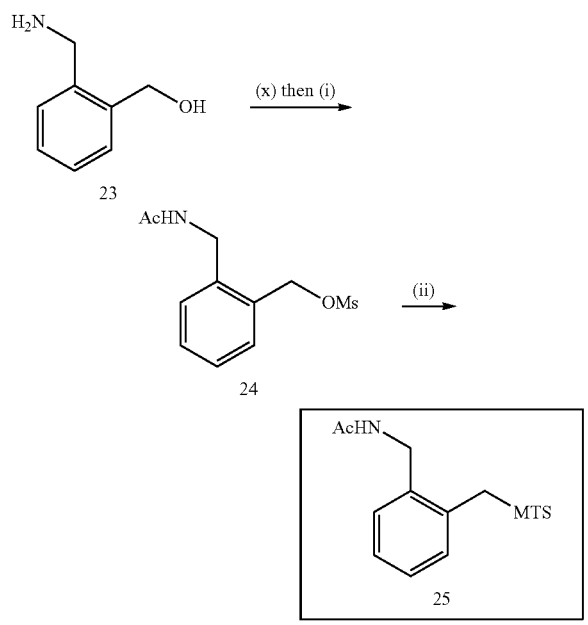

Compound 23:

Compound 23 is prepared according to a literature method (Journal of Medicinal Chemistry, 50(23), 5568-5570, 2007).

Compound 24:

An ice-cold pyridine solution (10 mL) of compound 23 (1 mmol) is treated successively, in a dropwise fashion with acetyl chloride (1 mmol), then after 5 min with MsCl (1.1 mmol). The solution is warmed to room temperature then the solvent is removed. The residue is dissolved in EtOAc, washed with water, dried (MgSO$_4$), filtered and concentrated in vacuo. Purification by column chromatography affords pure compound 24.

Compound 25:

Compound 24 is converted to compound 25 by a procedure analogous to that described for compound 12.

Synthesis of Compound 27

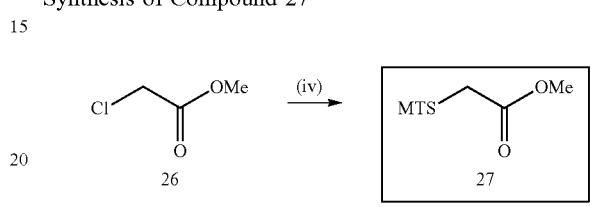

Compound 27:

Compound 26 was converted to compound 27 by a procedure analogous to that described for compound 14. $^1$H NMR (399 MHz, CDCl$_3$) δ 3.97 (s, 2H), 3.79 (s, 3H), 3.48 (s, 3H); $^{13}$C NMR (100 MHz, CDCl$_3$) δ 168.84, 53.35, 51.53, 37.83; MS (ESI +ve): calc (M+NH$_4$)$^+$: 202.02, found: 201.96; R$_f$=0.2 (20% EtOAc/hexane).

Synthesis of Compound 29

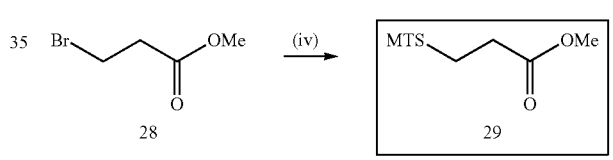

Compound 29:

Compound 28 was converted to compound 29 by a procedure analogous to that described for compound 14. $^1$H NMR (399 MHz, CDCl$_3$) δ 3.72 (s, 3H), 3.39 (t, J=6.8 Hz, 2H), 3.34 (s, 3H), 2.85 (t, J=6.8 Hz, 2H); $^{13}$C NMR (100 MHz, CDCl$_3$) δ 171.53, 52.29, 50.66, 34.51, 31.20; MS (ESI +ve): calc (M+NH$_4$)$^+$: 216.10, found: 216.04; R$_f$=0.2 (20% EtOAc/hexane).

Synthesis of Compound 31

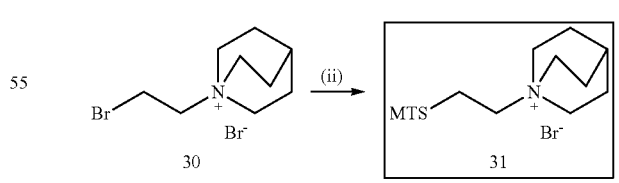

Compound 30:

Compound 30 is prepared according to a literature method (Tetrahedron, 42(2), 601-607; 1986).

Compound 31:

Compound 31 is prepared from compound 30 according to a patent procedure (US 20090181444).

Synthesis of Compound 33

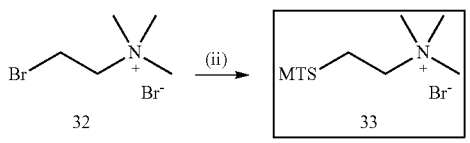

Compound 33:
Compound 33 is prepared from compound 32 according to a patent procedure (US 20090181444).

Synthesis of Compound 38

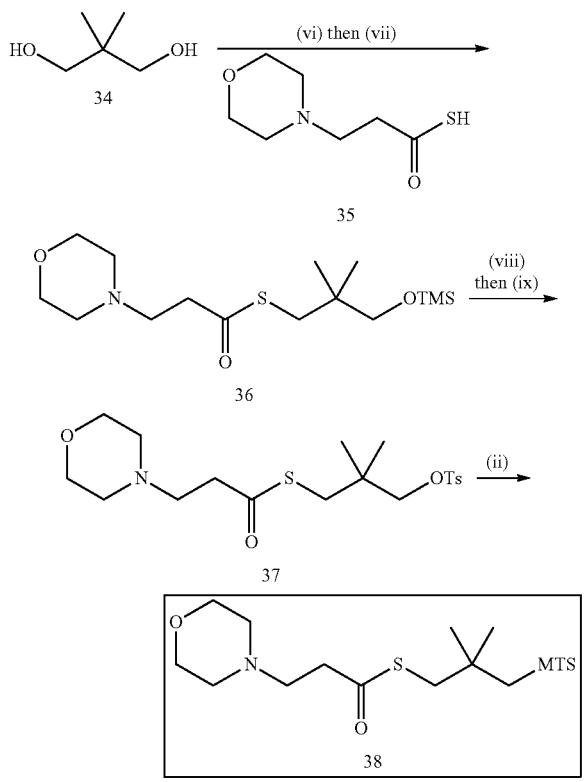

Compound 36:
An ice-cold DCM (20 mL) solution of compound 34 (1 mmol) is treated with NEt$_3$ (1 mmol) followed by the dropwise addition of TMS-Cl (1.1 mmol). After 1 h, the solution is washed with water, dried (MgSO$_4$), filtered and concentrated in vacuo. The crude TMS protected material is re-dissolved in THF (10 mL), whereon PPh$_3$ (1.2 mmol), compound 35 (1.2 mmol), then DEAD (1.2 mmol, dropwise) are added in succession. After stirring at room temperature for 18 h, the solvent is removed under vacuum, the residue is re-dissolved in DCM, the solution of which is washed with water, dried (MgSO$_4$), filtered and concentrated in vacuo. Purification by column chromatography affords pure compound 36.

Compound 37:
A THF (10 mL) solution of compound 36 (0.5 mmol) is treated with TBAF (1 mmol of a 1M solution in THF), with monitoring by TLC. On completion of TMS cleavage, the solvent is removed under vacuum, and the residue is re-dissolved in DCM, the solution of which is washed with water, dried (MgSO$_4$), filtered and reduced in vacuo. The crude alcohol is re-dissolved in pyridine (5 mL), and TsCl (0.55 mmol) is added. After 18 h at room temperature, the solvent is removed, and the residue is re-dissolved in DCM, the solution of which is washed with water, dried (MgSO$_4$), filtered and reduced in vacuo. Purification by column chromatography affords pure compound 37.

Compound 38:
Compound 37 is converted to compound 38 by a procedure analogous to that described for compound 12.

Synthesis of Compound 41

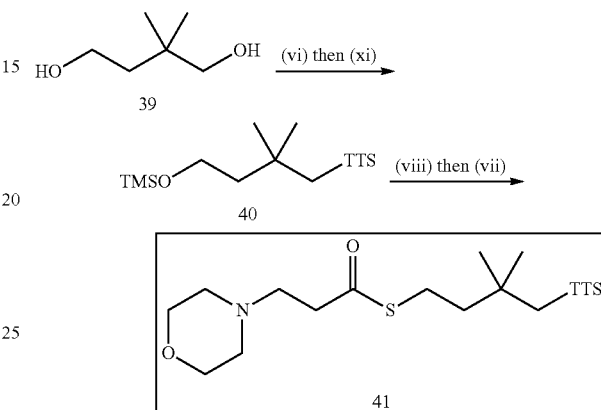

Compound 40:
An ice-cold DCM (20 mL) solution of compound 39 (1 mmol) is treated with NEt$_3$ (1 mmol) followed by the dropwise addition of TMS-Cl (1.1 mmol). After 1 h, the solution is washed with water, dried (MgSO$_4$), filtered and concentrated in vacuo. The crude TMS protected material is re-dissolved in THF (10 mL), whereon PPh$_3$ (1.2 mmol), potassium p-toluenethiosulfonate (KTTS, 1.2 mmol), anhydrous ZnCl$_2$ (1 mmol) then DEAD (1.2 mmol, dropwise) are added in succession. After stirring at r.t. for 18 h, the solvent is removed under vacuum, and the residue is re-dissolved in DCM, the solution of which is washed with water, dried (MgSO$_4$), filtered and concentrated in vacuo. Purification by column chromatography affords pure compound 40.

Compound 41:
A THF (10 mL) solution of compound 40 (0.5 mmol) is treated with TBAF (1 mmol of a 1M solution in THF), with monitoring by TLC. On completion of TMS cleavage, the solvent is removed under vacuum, and the residue is re-dissolved in DCM, the solution of which is washed with water, dried (MgSO$_4$), filtered and concentrated in vacuo. The crude alcohol is re-dissolved in THF (10 mL), whereon PPh$_3$ (1.2 mmol), compound 35 (1.2 mmol), then DEAD (1.2 mmol, dropwise) are added in succession. After stirring at r.t. for 18 h, the solvent is removed under vacuum, and the residue is re-dissolved in DCM, the solution of which is washed with water, dried (MgSO$_4$), filtered and concentrated in vacuo. Purification by column chromatography affords pure compound 41.

Synthesis of Compound 43

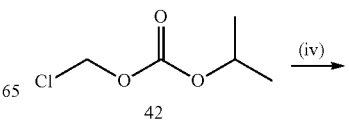

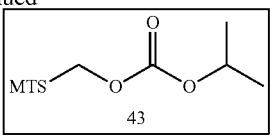

Compound 43:
Compound 42 is converted to compound 43 by a procedure analogous to that described for compound 14.

Synthesis of Compound 45a, 45b, 47a and 47b

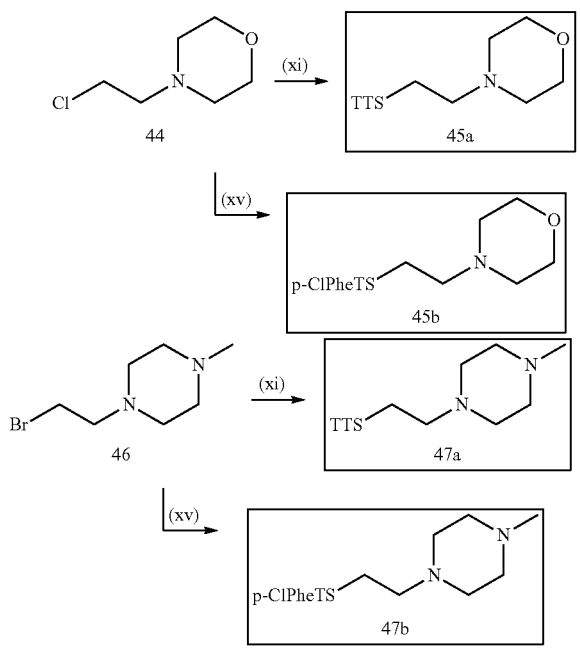

Compound 45a: A mixture of 4-(2-chloroethyl)morpholine hydrochloride (compound 44) (50 g, 269 mmol), sodium iodide (4.03 g, 26.9 mmol) and potassium 4-methylbenzenesulfonothioate (73.0 g, 322 mmol) was stirred in MeOH (200 ml) and heated at 60° C. over 72 h. The pale yellow mixture was cooled and diluted with 200 mL water, stirred for 0.5 h then the white solid was collected by filtration, washed with water (100 mL), IPA (200 mL), EtOAc (200 mL) and ether (200 mL). Dried mass=68 g. This microcrystalline powder was recrystallized from 90° C. water (200 mL) and the crystalline mass was collected by filtration after standing at r.t. overnight (64 g, 71%). $^1$H NMR (500 MHz, CDCl$_3$) δ 7.83 (d, J=8.4 Hz, 2H), 7.36 (d, J=8.4 Hz, 2H), 3.67 (t, J=4.7 Hz, 4H), 3.16 (t, J=6.9 Hz, 2H), 2.64 (t, J=6.9 Hz, 2H), 2.47 (s, 3H), 2.41 (t, J=4.4 Hz, 4H); $^{13}$C NMR (100 MHz, CDCl$_3$) δ 144.82, 141.99, 129.95, 127.14, 66.85, 56.54, 53.18, 33.44, 21.78; MS (ESI +ve): calc (M+H)$^+$: 302.08, found: 302.22.

Compound 45b:
Replacing potassium 4-methylbenzenesulfonothioate with potassium 4-chlorobenzenesulfonothioate compound 45b was synthesized by a method analogous to that described for compound 45a. (ESI +ve): calc (M+H)$^+$: 324.03, 322.04, found: 324.22, 322.20 ($^{37}$Cl, $^{35}$Cl isotope pattern).

Compound 47a:
Replacing 4-(2-chloroethyl)morpholine hydrochloride with 4-(2-bromooethyl)-N-methyl piperazine hydrobromide (compound 46), compound 47a was synthesized by a method analogous to that described for compound 45a. MS (ESI +ve): calc (M+H)$^+$: 315.12, found: 315.07.

Compound 47b: Replacing 4-(2-chloroethyl)morpholine hydrochloride with 4-(2-bromooethyl)-N-methylpiperazine hydrobromide and potassium 4-methylbenzenesulfonothioate with potassium 4-chlorobenzenesulfonothioate compound 47b is synthesized by a method analogous to that described for compound 45a.

Synthesis of Compound 50

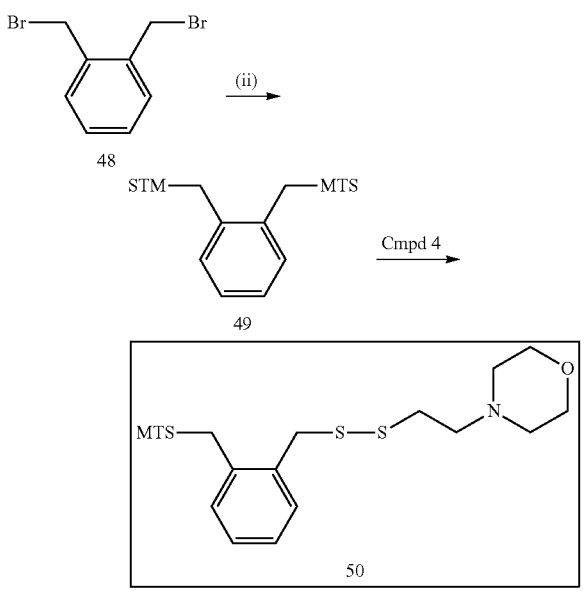

Compound 49:
A mixture of compound 48, (500 mg, 1.894 mmol) and sodium methanesulfonothioate (534 mg, 3.98 mmol) was dissolved in acetone (10 ml) and stirred at r.t. for 4 h. TLC indicated a complete reaction. The solvent was removed then the mixture was partitioned by addition of water and DCM. Upon extraction, the organic layer was separated then dried (MgSO$_4$), filtered and concentrated in vacuo. Column chromatography afforded the pure product as a colorless solid (0.60 g, 97%). $^1$H NMR (399 MHz, CDCl$_3$) δ 7.47 (dd, J=5.5, 3.5 Hz, 2H), 7.38 (dd, J=5.5, 3.5 Hz, 2H), 4.55 (s, 4H), 3.13 (s, 6H); $^{13}$C NMR (100 MHz, CDCl$_3$) δ 133.41, 131.75, 129.51, 51.02, 37.09; MS (ESI +ve): calc (M+NH$_4$)$^+$: 344.01, found: 344.01; R$_f$=0.5 (1:1 EtOAc/hexane).

Compound 50:
A DCM solution (2 mL) compound 4, (180 mg, 1.225 mmol) was added dropwise via syringe to a stirring solution of compound 49 (400 mg, 1.225 mmol) in DCM (20 mL) at r.t. After 0.5 h, the mixture was partitioned by addition of NaHCO$_3$. Upon extraction, the organic layer was separated then dried (MgSO$_4$), filtered and concentrated in vacuo. Column chromatography gave the product (170 mg, 35%) as a colorless oil. $^1$H NMR (399 MHz, CDCl$_3$) δ 7.43-7.39 (m, 1H), 7.35-7.27 (m, 3H), 4.54 (s, 2H), 4.03 (s, 2H), 3.67 (t, J=4.6 Hz, 4H), 3.05 (s, 3H), 2.58-2.50 (m, 4H), 2.38 (t, J=4.6 Hz, 4H); $^{13}$C NMR (100 MHz, CDCl$_3$) δ 136.09, 133.20, 131.87, 131.21, 128.86, 128.54, 66.95, 57.95, 53.52, 51.04, 40.81, 38.18, 35.82; MS (ESI +ve): calc (M+H): 394.06, found: 394.23; R$_f$=0.5 (EtOAc).

Synthesis of Compound 55

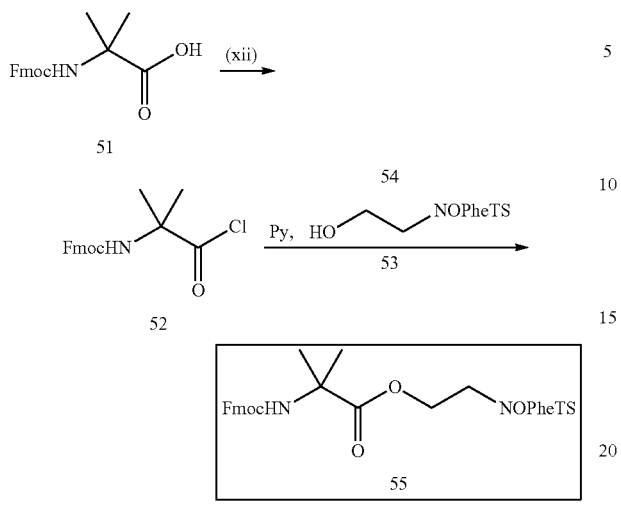

Compound 54:

Bromine (0.246 ml, 4.78 mmol) in DCM (50 mL) was added in a dropwise fashion over 0.5 h to a stirring mixture of sodium 4-nitrobenzenesulfinate (2 g, 9.56 mmol) and 2-hydroxyethyl disulfide (0.585 ml, 4.78 mmol) in DCM (50 mL) at r.t. After 2 h at r.t. the mixture was filtered to remove salt. The solvent was removed then column purification by column chromatography gave the product (2.1 g, 83%) as a colorless oil. $R_f$=0.4 (1:1 EA/hexane). $^1$H NMR (399 MHz, CDCl$_3$) δ 8.41 (d, J=8.8 Hz, 2H), 8.13 (d, J=8.8 Hz, 2H), 3.89 (t, J=5.8 Hz, 2H), 3.23 (t, J=5.8 Hz, 2H), 2.02-1.94 (s, br, 1H); $^{13}$C NMR (100 MHz, CDCl$_3$) δ 149.73, 128.40, 124.82, 60.94, 39.28.

Compound 55:

Compound 51 (1 g, 3.07 mmol) in DCM (50 mL) was treated dropwise with oxalyl dichloride (0.527 ml, 6.15 mmol) and stirred at r.t. During the reaction a colorless homogeneous solution was formed. After 1 h at r.t. the solvent was removed under reduced pressure. The white residue (crude acid chloride, compound 52) was re-dissolved in DCM (20 mL) and added to a stirring solution of compound 54 (0.48 g, 3.1 mmol) in pyridine (20 mL). After 18 h, it was judged that the reaction was complete. The solvents were removed. The residue was re-dissolved in toluene and partitioned with water. The toluene extracts were collected, washed with brine, dried (MgSO$_4$), filtered and concentrated. Column chromatography afforded pure compound 55 (0.86 g, 60%) as a colorless solid. $^1$H NMR (399 MHz, CDCl$_3$) δ 8.31 (d, J=8.9 Hz, 2H), 8.03 (d, J=8.9 Hz, 2H), 7.7 (d, J=7.5 Hz, 2H), 7.58 (d, J=7.5 Hz, 2H), 7.42 (t, J=7.5 Hz, 2H), 7.32 (dt, J=7.5, 1.2 Hz, 2H), 5.22 (s, br, 1H), 4.34 (s, br, 4H), 4.19 (t, J=6.8 Hz, 1H), 3.23 (t, J=6.0 Hz, 2H), 4.17 (s, br, 6H); $^{13}$C NMR (100 MHz, CDCl$_3$) δ 173.91, 155.10, 150.60, 149.53, 143.85, 141.42, 128.27, 128.20, 127.91, 127.22, 127.18, 125.12, 124.84, 120.17, 66.81, 62.60, 56.40, 47.25, 34.76, 25.37; MS (ESI +ve): calc (M+H)$^+$: 571.11, found: 571.00; $R_f$=0.5 (EtOAc).

Synthesis of Compound 59

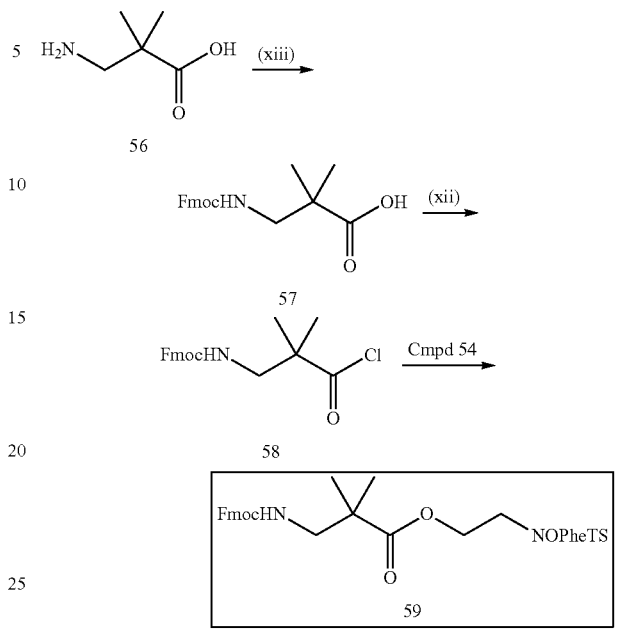

Compound 57:

Compound 57 is prepared from compound 56 (1 mmol) by reaction with 1.5 eq Fmoc-OSu in pyridine at r.t. for 18 h. Aqueous workup then column chromatography affords pure compound 57.

Compound 59:

Compound 59 is prepared from compound 57 by a procedure analogous to that described for compound 55.

Synthesis of Compound 63

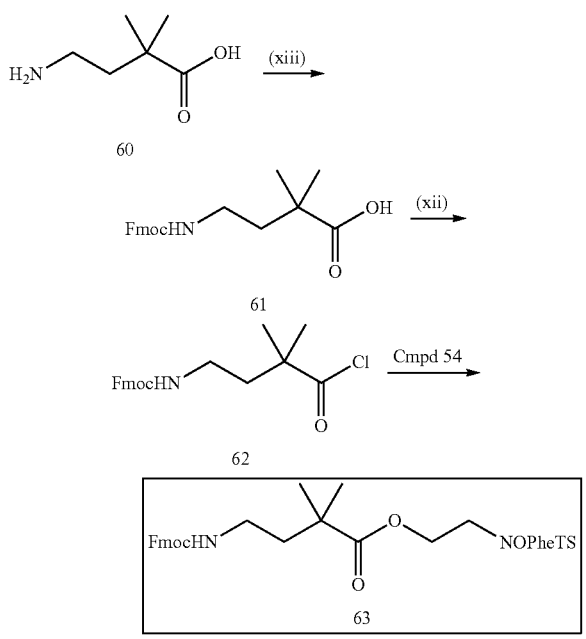

Compound 61:

Compound 61 is prepared from compound 60 by a procedure analogous to that described for compound 57.

Compound 63:

Compound 63 is prepared from compound 61 by a procedure analogous to that described for compound 55.

Synthesis of Compound 69

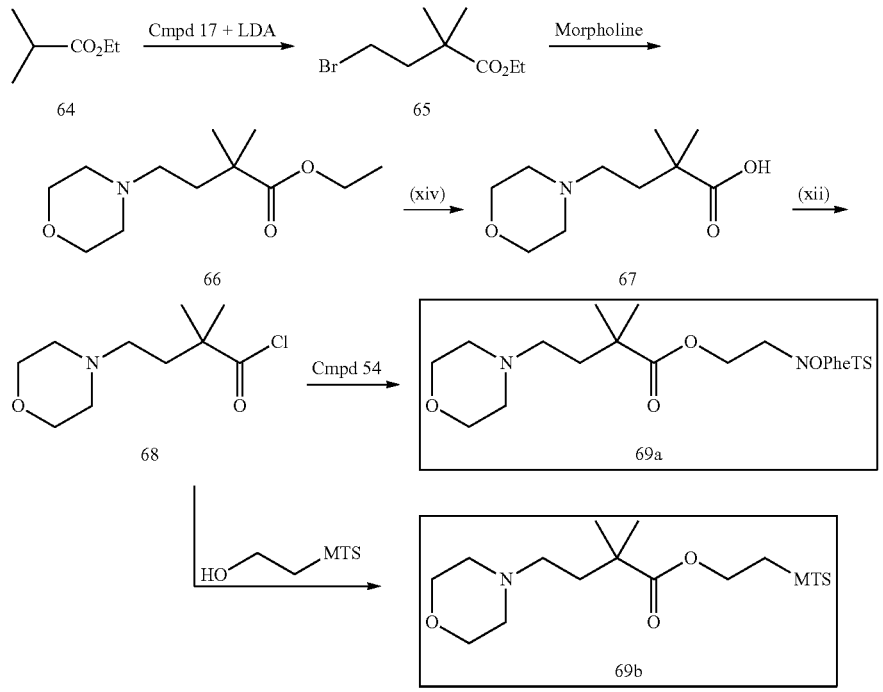

Compound 65:

Ethyl isobutyrate, (11.6 g, 100 mmol) was added over 0.5 h to a cooled (−78° C.) solution of LDA in THF (53 mL, 2M). The orange mixture was then warmed to 0° C. briefly before re-cooling to −78° C. 1,2-dibromoethane (20 g, 106 mmol) was then added over 0.5 h to the solution which was warmed gradually to r.t. and stirred overnight. The resulting mixture was partitioned by addition of water and EA. Upon extraction into EA and washing with brine, the organic layer was separated then dried (MgSO$_4$), filtered and concentrated in vacuo. Column chromatography gave the pure product as a colorless oil (6.0 g, 25%). $^1$H NMR (399 MHz, CDCl$_3$) δ 4.15 (q, J=7.1 Hz, 2H), 3.35 (t, J=8.4 Hz, 2H), 2.16 (t, J=8.4 Hz, 2H), 1.27 (t, J=7.1 Hz, 3H), 1.22 (s, 6H); $^{13}$C NMR (100 MHz, CDCl$_3$) δ 176.78, 60.83, 43.83, 42.89, 28.45, 25.20, 14.32; R$_f$=0.5 (5% EtOAc/hexane).

Compound 66:

A mixture of compound 65 (3.4 g, 15.24 mmol) and morpholine (13.28 g, 152 mmol) in THF (20 ml) was heated at 50° C. in a glass pressure bottle over 72 h. A white precipitate was observed to form. The mixture was separated between water and EA. The EA extracts were dried (MgSO$_4$), filtered and concentrated. Column chromatography gave the product as a colorless liquid (3.5 g, 100%). $^1$H NMR (399 MHz, CDCl$_3$) δ 4.11 (q, J=7.1 Hz, 2H), 3.67 (t, J=4.7 Hz, 4H), 2.41 (t, br, J=4.0 Hz, 4H), 2.30-2.26 (m, 2H), 1.74-1.70 (m, 2H), 1.23 (t, J=7.1 Hz, 3H), 1.17 (s, 6H); $^{13}$C NMR (100 MHz, CDCl$_3$) δ 177.69, 67.11, 55.15, 54.02, 41.10, 37.04, 25.49, 14.35; MS (ESI +ve): calc (M+H)$^+$: 230.18, found: 230.33; R$_f$=0.5 (5% EtOAc/hexane).

Compound 67:

Compound 66 (120 mg, 0.523 mmol) and sodium hydroxide (120 mg, 3.00 mmol) were stirred together in 1:1 EtOH/H$_2$O (10 mL). After 36 h, the pH of the solution was adjusted to ca. 2 by addition of c. HCl, then NEt$_3$ was added until the pH reached ca. 10. SiO$_2$ (2 g) was added and the solvents/water were evaporated. Column chromatography with dry loading (MeOH/DCM, with 2% NEt$_3$ in the DCM), gave the product as a partial (approx ⅓ mol eq) HNEt$_3$ salt. The adjusted yield was 103 mg, 84%. $^1$H NMR (399 MHz, CDCl$_3$ plus 3 drops of DMSO-d6) δ 3.62 (t, J=4.7 Hz, 4H), 2.51-2.46 (br, 4H), 2.40 (t, J=7.1 Hz, 2H), 1.62 (J=7.1 Hz, 2H), 1.08 (s, 6H); $^{13}$C NMR (100 MHz, CDCl$_3$) δ 179.91, 65.91, 54.29, 52.87, 45.44, 41.37, 35.09, 25.93, 8.56; MS (ESI −ve): calc (M−H)$^+$: 200.13, found: 200.16; R$_f$=0.5 (2% NEt$_3$/10% MeOH/DCM).

Compound 69a:

A suspension of compound 67 (11 g, 54.9 mmol) in DCM (200 mL) was treated with oxalyl chloride (9.42 ml, 110 mmol) and stirred at r.t. During the reaction a colorless homogeneous solution was formed. After 1 h at r.t. the solvent was removed under reduced pressure. The yellow residue was suspended in a mixture of DCM (200 mL) and Py (100 mL) then S-2-hydroxyethyl compound 54 (15.91 g, 60.4 mmol) (DB-7-5) was added all at once and the reaction was monitored by HPLC/MS. After 18 h, it was judged by MS and TLC that the reaction was virtually complete. The solvents were removed then the residue was redissolved in DCM/bicarbonate. The combined organics were dried (MgSO$_4$), filtered and reduced. Purification by column chromatography gave 12.5 g, 51% of compound 69a as a yellow oil which crystallized on standing. $^1$H NMR (399 MHz, CDCl$_3$) δ 8.41 (d, J=8.5 Hz, 2H), 8.13 (d, J=8.5 Hz, 2H), 4.27 (t, J=6.3 Hz, 2H), 3.65 (t, J=4.6 Hz, 4H), 3.28 (t, J=6.3 Hz, 2H), 2.40 (s, br, 4H), 2.27 (t, J=7.7 Hz, 2H), 1.71 (t, J=7.7 Hz, 2H), 1.14 (s, 6H); $^{13}$C NMR (100 MHz, CDCl$_3$) δ 177.11, 150.71, 149.69, 128.34, 124.92, 66.96, 61.66, 54.95, 53.92, 41.25, 46.81, 35.11, 25.36; MS (ESI +ve): calc (M+H)$^+$: 447.12, found: 446.98.

Compound 69b:

A suspension of compound 67 (128 mg, 0.636 mmol) in DCM (12 mL) was treated dropwise with oxalyl chloride (545 μl, 6.36 mmol) and stirred at r.t. During the reaction a colorless homogeneous solution was formed which soon developed a colorless precipitate. HPLC/MS indicated good conversion to acid chloride (compound 68) as shown by conversion to the N-propyl amide. The solvent was removed under reduced pressure. The white residue was cooled on an ice bath and treated with a DCM (12 mL) solution of S-2-hydroxyethyl methanesulfonothioate (compound 54) (99 mg, 0.636 mmol), followed by dropwise addition of Hunig's base (0.34 g, 2.6 mmol, 4 eq) with stirring. After 1.5 h, the solution was washed with diluted $NaHCO_3$ (aq). The combined extracts were dried ($MgSO_4$), filtered and concentrated. Column chromatography gave the product as a colorless oil (84 mg, 39%). $^1$H NMR (399 MHz, $CDCl_3$) δ 4.40 (t, J=6.2 Hz, 2H), 3.70 (t, J=4.6 Hz, 4H), 3.44 (t, J=6.2 Hz, 2H), 3.39 (s, 3H), 2.47-2.43 (br, 4H), 2.32 (t, J=7.7 Hz, 2H), 1.77 (t, J=7.7 Hz, 2H), 1.64-1.58 (br, 4H), 1.22 (s, 6H); $^{13}$C NMR (100 MHz, $CDCl_3$) δ 177.30, 67.08, 62.27, 55.03, 54.01, 51.07, 41.32, 36.99, 35.14, 25.44; MS (ESI +ve): calc $(M+H)^+$: 340.13, found: 340.27; $R_f$=0.2 (EtOAc).

Synthesis of Compound 73

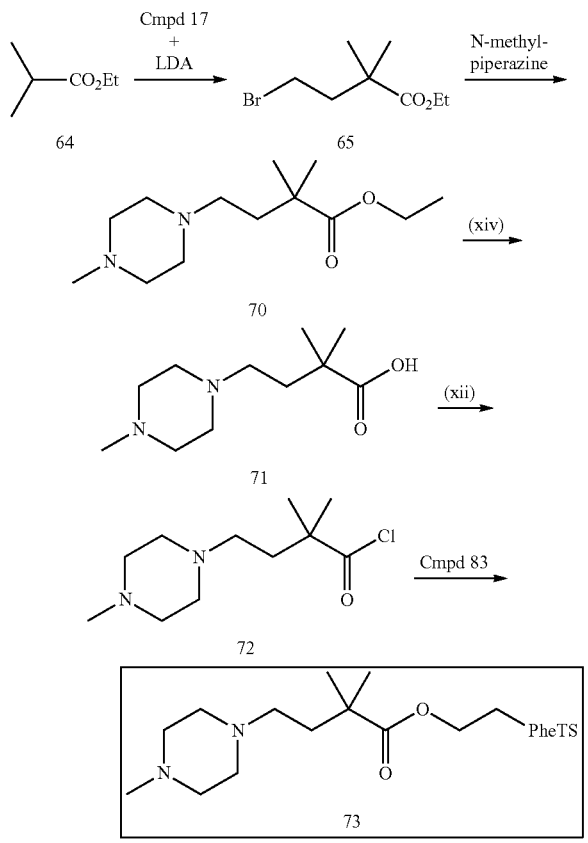

Compound 70:

Compound 70 was prepared by reaction of N-methyl piperazine with compound 65 by a procedure analogous to that described for compound 66. $^1$H NMR (399 MHz, $CDCl_3$) 4.10 (q, J=7.1 Hz, 2H), 2.3-2.6 (br, 8H), 2.28 (t, J=8.0 Hz, 2H), 2.26 (s, 3H), 1.72 (t, J=8.0 Hz, 2H), 1.23 (t, J=7.1 Hz, 3H), 1.15 (s, 6H); $^{13}$C NMR (100 MHz, $CDCl_3$) δ 177.71, 60.44, 55.27, 54.64, 53.50, 46.18, 41.15, 37.36, 25.47, 14.34; MS (ESI +ve): calc $(M+H)^+$: 243.20, found: 243.31.

Compound 71:

Compound 71 was prepared by hydrolysis of compound 70 using a procedure analogous to that described for compound 67. $^1$H NMR (399 MHz, $CDCl_3$) δ 12-10 (vbr, 1H), 3.2-2.2 (vbr, 8H), 2.44 (t, J=8.0 Hz, 2H), 2.36 (s, 3H), 1.71 (t, J=8.0 Hz, 2H), 1.17 (s, 6H), $^{13}$C NMR (100 MHz, $CDCl_3$) δ 181.36, 55.18, 53.51, 52.18, 44.31, 41.57, 37.19, 26.28; MS (ESI +ve): calc $(M+H)^+$: 215.17, found: 215.19.

Compound 83:

Bromine (2.58 ml, 50.0 mmol) in DCM (50 mL) was added in a dropwise fashion over 0.5 h to a stirring mixture of sodium benzenesulfinate (16.4 g, 100 mmol) and 2-hydroxyethyl disulfide (6.11 ml, 49.9 mmol) in DCM (50 mL) at r.t. After 2 h at r.t. TLC showed good reaction (Rf=0.4 (1:1 EA/hexane), so the mixture was filtered to remove salt. The solvent was removed then column chromatography gave the product (17.4 g, 80%) as a colorless oil.

Compound 73:

Compound 71 (1.342 g, 6.29 mmol), in DCM (20 mL) was treated with oxalyl chloride (1.079 ml, 12.58 mmol) and stirred at r.t. During the reaction a pale yellow precipitate was observed to form. After 0.5 h at r.t. the solvent was removed under reduced pressure. The pale yellow residue was suspended in a mixture of DCM (20 mL) and Py (20 mL) then compound 83 (2.060 g, 9.44 mmol) was added all at once. After 18 h, it was judged by TLC that the reaction was complete. The solvents were removed then the residue was redissolved in water and washed with ether. The aqueous layer was reduced to a brown solid. Recrystallization from boiling EtOH (10 mL) gave a slightly impure HCl salt which was free based ($NEt_3$ in DCM) then loaded directly onto silica gel. Column chromatography gave 0.95 g, 36% of pure compound 73. $^1$H NMR (399 MHz, $CDCl_3$) δ 7.96 (d, J=8.0 Hz, 2H), 7.68 (t, J=7.2 Hz, 1H), 7.59 (t, J=7.7 Hz, 2H), 4.25 (t, J=6.3 Hz, 2H), 3.25 (t, J=6.3 Hz, 2H), 2.8-2.3 (vbr, 8H), 2.36 (s, 3H), 2.33 (t, J=7.7 Hz, 2H), 1.74 (t, J=7.7 Hz, 2H), 1.16 (s, 6H); $^{13}$C NMR (100 MHz, $CDCl_3$) δ 177.13, 144.68, 134.09, 129.59, 127.09, 61.99, 54.86, 54.35, 52.84, 45.95, 45.71, 41.26, 37.05, 34.66, 25.39; MS (ESI +ve): calc $(M+H)^+$: 415.17, found: 415.09.

Synthesis of Compound 76

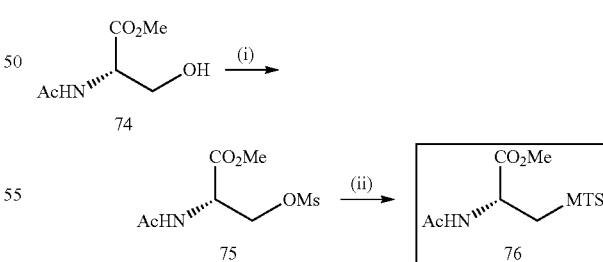

Compound 75:

Compound 74 was converted to compound 75 by a procedure analogous to that described for compound 2. $^1$H NMR (500 MHz, $CDCl_3$) δ 6.49-6.41 (br, d, J=6.3 Hz, 1H), 4.91 (dt, J=6.3, 2.7 Hz, 1H), 4.59 (ddd, J=31.4, 10.6, 3.0 Hz, 2H), 3.84 (s, 3H), 3.04 (s, 3H), 2.09 (s, 3H); 170.27, 169.05, 68.90, 53.33, 52.03, 37.63, 23.16; MS (ESI +ve): calc $(M+H)^+$: 240.06, found: 240.24.

Compound 76:

Compound 75 was converted to compound 76 by a procedure analogous to that described for compound 3. $^1$H NMR (500 MHz, CDCl$_3$) δ 6.56-6.40 (br, d, J=6.2 Hz, 1H), 4.93 (q, J=5.9 Hz, 1H), 3.81 (s, 3H), 4 3.74 (dd, J=14.6, 4.8 Hz, 1H), 3.57 (dd, J=14.6, 5.6 Hz, 1H), 3.38 (s, 3H), 2.07 (s, 3H); $^{13}$C NMR (126 MHz, CDCl$_3$) δ 170.44, 170.19, 53.23, 52.02, 50.73, 37.77, 23.12; MS (ESI +ve): calc (M+H)$^+$: 256.03, found: 256.21.

Synthesis of Compound 78

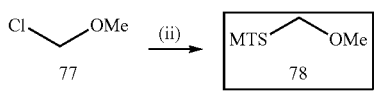

A mixture of compound 77, (2.49 ml, 32.8 mmol), and sodium methanesulfonothioate (4.4 g, 32.8 mmol) was stirred in acetone (80 ml) over 6 h. The acetone was removed by rotary evaporation and the mixture was triturated with DCM. After filtration, DCM was removed by evaporation (5 g crude yield) and the mixture was subjected to purification by column chromatography. Yield of pure compound 78 was 2.8 g, 55%, colorless oil, Rf=0.3 (20% EA/hexane). $^1$H NMR (500 MHz, CDCl$_3$) δ 5.30 (s, 2H), 3.48 (s, 3H), 3.38 (s, 3H); $^{13}$C NMR (126 MHz, CDCl$_3$) δ 80.07, 57.40, 22.71.

Synthesis of Compound 80

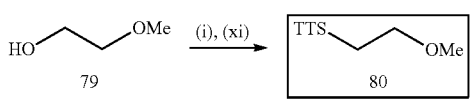

An ice-cold solution of compound 79 (5 g, 65.7 mmol) and triethylamine (11 ml, 79 mmol) in DCM (150 mL) was treated with methanesulfonyl chloride (5.59 ml, 72.3 mmol) over 2 min. After 1 h the reaction was judged to be complete by TLC. Water was added and the organic extracts were washed sequentially with dilute HCl, saturated sodium bicarbonate, brine, then dried (MgSO$_4$), filtered and reduced. The product mesylate (9.4 g, 61 mmol, 96%) was taken up in acetone (200 ml), then the potassium salt of toluene thiosulfinic acid (61 mmol) was added and the solution was stirred at 50° C. over 18 h. A thick white precipitate was observed to form. The mixture was filtered, reduced to an oil then extracted into DCM/water. The organic extracts were dried (MgSO$_4$), filtered and reduced. Column chromatography gave pure compound 80 as a colorless oil which crystallized on standing Rf=0.3 (20% EA/hexane)

Synthesis of Compound 82

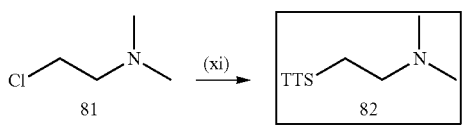

A mixture of 2-chloro-N,N-dimethylethanamine hydrochloride (10 g, 69.4 mmol), sodium iodide (1.041 g, 6.94 mmol) and potassium 4-methylbenzenesulfonothioate (18.86 g, 83 mmol) was stirred in MeOH (50 ml) and heated at 60° C. over 72 h. Aqueous workup then column chromatography gave pure compound 82 (8.5 g, 47%) as a colorless oil. $^1$H NMR (399 MHz, CDCl$_3$) δ 7.81 (d, J=8.4 Hz, 2H), 7.33 (dd, J=8.4, 0.6 Hz, 2H), 3.09 (t, J=6.8 Hz, 2H), 2.53 (t, J=6.8 Hz, 2H), 2.44 (s, 3H), 2.17 (s, 6H); $^{13}$C NMR (100 MHz, CDCl$_3$) δ 144.76, 142.03, 129.92, 127.18, 57.51, 45.14, 34.29, 21.77; MS (ESI +ve): calc (M+H)$^+$: 260.07, found: 260.16.

Synthesis of Compound 85

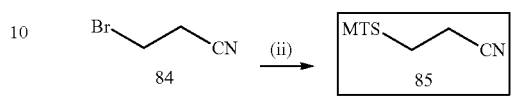

Sodium methanesulfonate (11.5 g, 86 mmol) was placed in a dry 50 mL one neck flask. 30 mL of anhydrous DMF (Aldrich) was added using a dry glass syringe. 5 mL of 3-bromopropionitrile (compound 84) (8.2 g, 61.2 mmol) was added using a dry glass syringe. The reaction flask was closed under argon, sealed and stirred for 24 h at 50° C. The reaction was monitored using TLC (system: hexanes/ethyl acetate—5:5—v/v). The reaction mixture was diluted with 100 mL of ethyl acetate and washed 5 times with water (5×100 mL). The organic layers were dried over sodium sulfate, filtered and evaporated to dryness. The residue was dissolved in 5 mL of dichloromethane and purified by silica gel chromatography (CombiFlash) using a linear gradient of ethyl acetate in hexanes. Pure compound 85 (7.2 g, 52%) was obtained as a colorless oil. $^1$H-NMR (CDCl$_3$, 399 MHz). δ 3.43 (s, 3H), 3.41 (t, 2H, J=2.5 Hz), 2.93 (t, 2H, J=2.5 Hz); $^{13}$C-NMR (CDCl$_3$, 100 MHz) δ 117.7, 51.2, 31.7, 19.6.

Synthesis of Compound 87

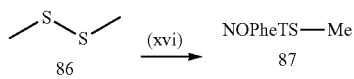

Compound 87:

Compound 86 (1.11 mL, 12.5 mmol) and sodium 4-nitrobenzenesulfinate (5.23 g, 25.0 mmol) were added in DCM (12.5 mL) to give a white suspension. Dibromine (0.64 ml, 12.5 mmol) was added to the stirred solution. The solution was stirred for 30 min at r.t. and filtrated to remove the salt, then the filtrate was evaporated under reduced pressure. The crude product was added to a silica gel column and was eluted with hexane-EtOAc to give pure compound 87 (4.80 g, 20.6 mmol, 82% yield). $^1$H NMR (399 MHz, CDCl$_3$) δ 8.44-8.40 (m, 2H), 8.15-8.10 (m, 2H), 2.58 (s, 3H); $^{13}$C NMR (100 MHz, CDCl$_3$) δ 149.00, 128.54, 124.87, 94.61, 18.55; R$_f$=0.60 (1:1 EtOAc/hexane).

Synthesis of Compound 90

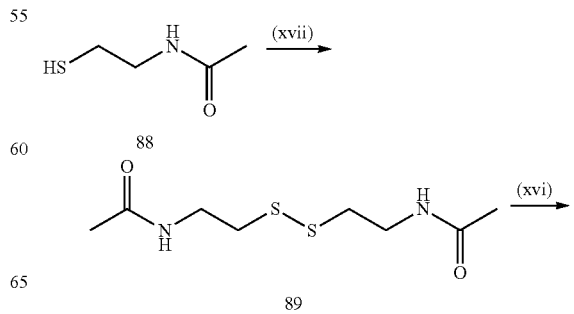

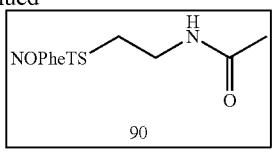

Compound 89:

In a 1 L round-bottomed flask N-(2-mercaptoethyl)acetamide, 88 (11.92 g, 100 mmol) was dissolved in EtOAc (300 mL) to give a colorless solution. Sodium iodide (0.150 g, 1.000 mmol) and 30% hydrogen peroxide (3.40 g, 100 mmol) in H$_2$O (11.3 mL) were added to the solution which was stirred for 45 min at r.t. Saturated Na$_2$S$_2$O$_3$ was added to the solution. The aqueous layer was extracted with EtOAc (3×300 mL). The combined organic layers were dried with Na$_2$SO$_4$, filtered and concentrated by rotary evaporation. The crude product was subjected to column chromatography and was eluted with a MeOH/DCM gradient to give pure compound 89 (4.94 g, 20.90 mmol, 41.8% yield), which was judged by TLC to be sufficiently pure for direct use in the next step of the reaction. R$_f$=0.35 (9:1 DCM/Methanol)

Compound 90:

In a 100 mL round-bottomed flask, compound 89 (2.364 g, 10.00 mmol) and sodium 4-nitrobenzenesulfinate (4.18 g, 20 mmol) were dissolved in CH$_2$Cl$_2$ (20 mL) to give a white suspension. Dibromine (0.516 ml, 10.00 mmol) was added to the stirred solution. The solution was stirred for 30 min at r.t. and filtrated to remove the salt, then the filtrate was evaporated under reduced pressure. The crude product was added to a silica gel column and was eluted with hexane-EtOAc to give pure compound 90 (2.37 g, 7.79 mmol, 39% yield). $^1$H NMR (399 MHz, CDCl$_3$) δ 8.45-8.40 (m, 2H), 8.17-8.12 (m, 2H), 3.60-3.54 (dt, 2H), 3.21-3.16 (t, 2H), 2.00 (s, 3H); $^{13}$C NMR (100 MHz, CDCl$_3$) δ 130.35, 126.27, 66.97, 58.20, 53.67, 51.52, 36.22, 35.16, 33.67; R$_f$=0.40 (EtOAc).

Synthesis of Compounds 93 and 94 g, 12.8 mmol, 43% yield). $^1$H NMR (399 MHz, CDCl$_3$) δ 7.87-7.84 (m, 4H), 7.56-7.51 (m, 4H), 5.56-5.50 (m, 2H), 3.72-3.68 (m, 4H); $^{13}$C NMR (100 MHz, CDCl$_3$) 130.35, 126.27, 66.97, 58.20, 53.67, 51.52, 36.22, 35.16, 33.67; R$_f$=0.35 (1:3 EtOAc/hexane).

Compound 93:

In a 100 mL round-bottomed flask compound 92 (3.09 g, 6.58 mmol) was dissolved in THF at 0° C. Triethylamine (459 μL, 3.29 mmol) and 2-methyl-2-propanethiol (742 μL, 6.58 mmol) were added to the stirred solution at 0° C. The solution was stirred for 20 min at 0° C., then triethylamine (230 μL, 1.65 mmol) was added to the stirred solution at 0° C. After stirring for 40 min at 0° C., the solvents were removed under reduced pressure. The resultant was subjected to column chromatography and was eluted with an EtOAc/hexane gradient to give compound 93 (1.77 g, 4.62 mmol, 70% yield). $^1$H NMR (399 MHz, CDCl$_3$) δ 7.90-7.85 (m, 2H), 7.56-7.52 (m, 2H), 5.73-5.65 (m, 1H), 5.55-5.48 (m, 1H), 3.78-3.75 (d, 2H), 3.36-3.32 (d, 2H), 1.32 (s, 9H); $^{13}$C NMR (100 MHz, CDCl$_3$) δ 143.54, 140.60, 130.90, 129.83, 128.66, 124.56, 48.29, 37.05, 33.35, 30.16; R$_f$=0.60 (1:3 EtOAc/hexane).

Compound 94:

Using a procedure analogous to that described for compound 93, and substituting 2-propanethiol for 2-methyl-2-propanethiol, pure compound 94 was obtained (1.13 g, 3.06 mmol, 72% yield). $^1$H NMR (399 MHz, CDCl$_3$) δ 7.90-7.82 (m, 2H), 7.56-7.48 (m, 2H), 5.72-5.64 (m, 1H), 5.57-5.47 (m, 1H), 3.79-3.72 (d, 2H), 3.33-3.26 (d, 2H), 3.61-2.92 (m, 1H), 1.27 (d, 6H); $^{13}$C NMR (100 MHz, CDCl$_3$) δ 143.28, 140.36, 131.37, 125.63, 124.55, 124.56, 41.32, 38.02, 35.81, 33.08, 22.54; R$_f$=0.55 (1:3 EtOAc/hexane).

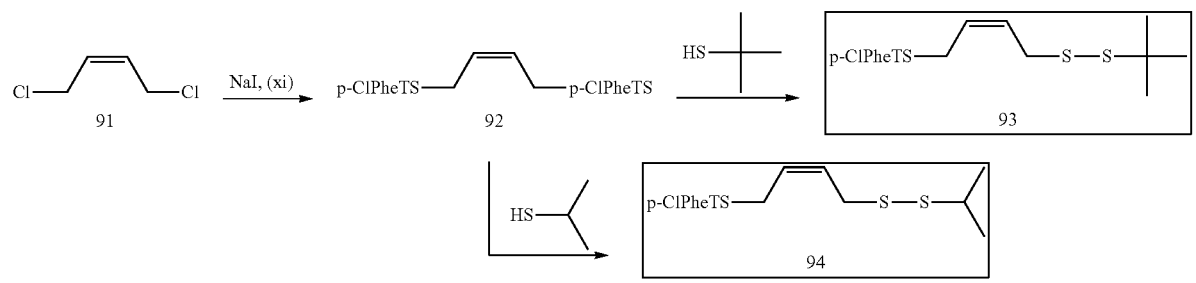

Compound 92:

In a 250 mL round-bottomed flask, sodium 4-chlorobenzenesulfonothioate (14.5 g, 63.0 mmol) was dissolved in MeOH. Cis-1,4-dichloro-2-butene, 91 (3.16 g, 30.0 mmol) and sodium iodide (450 mg, 3.0 mmol) was added to the stirred solution. The solution was stirred for 3 h at r.t., then heated up to 50° C. After stirring for 18 h at 50° C., solvents were removed under reduced pressure. The resulting crude material was diluted with DCM (300 mL) and washed with water (1×100 mL). The aqueous layer was extracted with DCM (1×100 mL). Combined organic layers were dried with Na$_2$SO$_4$, filtered and concentrated. The crude product was subjected to column chromatography and was eluted with an EtOAc/hexane gradient to give compound 92 (5.99

Synthesis of Compound 96

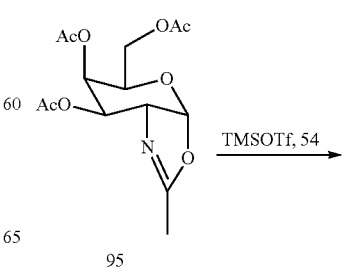

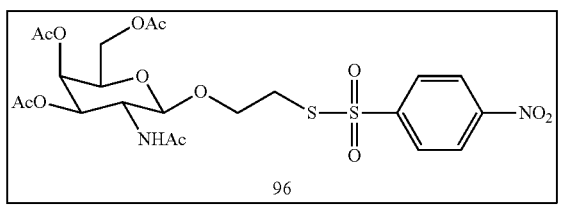

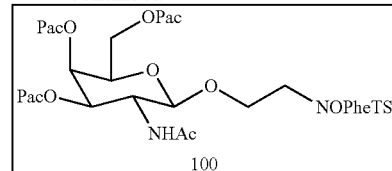

Compound 96:

Compounds 9 (1.81 g, 5.50 mmol) and 54 (2.17 g, 8.25 mmol) were combined and dried by co-evaporation with anhydrous toluene (3×2 mL). The mixture was dissolved in dry 1,2-dichloroethane (16.5 mL). 4 Å molecular sieves were added to the solution and the mixture was stirred 30 min at r.t. Trimethylsilyltriflate (497 μL, 2.75 mmol) was added to the stirred solution. The solution was stirred for 9 h at r.t., then additional 54 (0.723 g, 2.75 mmol) was added to the stirred solution. After stirring 16 h at r.t., the solution was diluted with DCM (100 mL) and washed with sat. NaHCO$_3$ (1×100 mL). The aqueous layer was extracted with DCM (1×50 mL). The combined organic layers were dried with Na$_2$SO$_4$, filtered and concentrated by rotary evaporation. The resulting crude was subjected to column chromatography and was eluted with an EtOAc/hexane gradient to give compound 96 (2.21 g, 3.73 mmol, 68% yield). $^1$H NMR (399 MHz, CDCl$_3$) δ 8.42-8.36 (d, 2H), 8.12-8.06 (d, 2H), 6.07-6.00 (d, 1H), 5.33-5.30 (d, 1H), 5.23-5.15 (dd, 1H), 4.69-4.63 (d, 1H), 4.15-4.04 (m, 3H), 4.04-3.87 (m, 2H), 3.84-3.73 (m, 1H), 3.22-3.12 (t, 2H), 2.12-1.92 (m, 12H); $^{13}$C NMR (100 MHz, CDCl$_3$) 179.95, 170.74, 170.48, 150.77, 149.59, 128.47, 125.03, 101.40, 71.08, 70.02, 67.39, 66.92, 61.76, 51.12, 36.51, 23.72, 20.92; R$_f$=0.25 (1:9 MeOH/DCM).

Synthesis of Compound 100

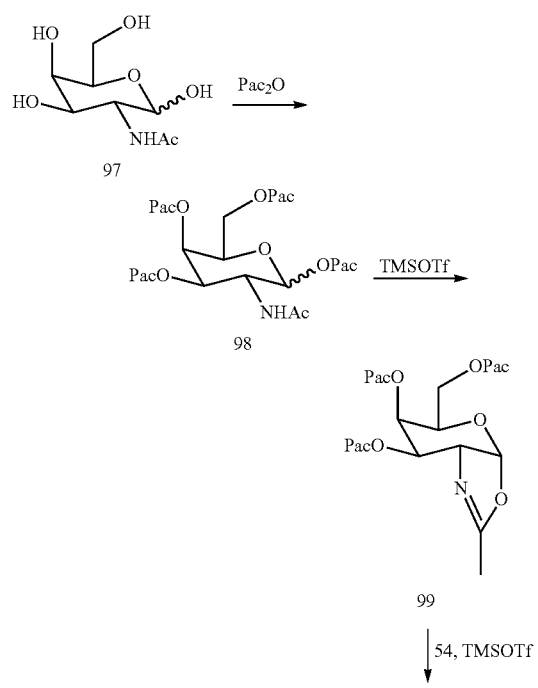

Compound 98:

An ice-cold solution of compound 97 (4.87 g, 22.0 mmol) in dry pyridine (70 mL) was treated with phenoxyacetic anhydride (37.8 g, 132.0 mmol) and 4-dimethylaminopyridine (26.9 mg, 220 μmol). After stirring at r.t. for 12 h, the mixture was concentrated and co-evaporated with toluene in vacuo. The resultant was diluted by DCM (400 mL) and washed with sat. NaHCO$_3$ (1×400 mL). Upon extraction, the organic layer was separated, dried with Na$_2$SO$_4$, filtered and concentrated in vacuo. The resultant was subjected to column chromatography and was eluted with an EtOAc/hexane gradient to give pure compound 98 (16.7 g, 22.0 mmol, 100% yield). $^1$H NMR (399 MHz, CDCl$_3$) δ 7.36-6.75 (m, 20H), 6.27-6.20 (d, 1H), 5.43-5.36 (m, 1H), 5.22-5.06 (m, 2H), 4.81-4.65 (m, 3H), 4.60-4.52 (m, 2H), 4.45-4.29 (m, 2H), 4.17-4.02 (m, 2H), 3.97-3.87 (m, 1H), 1.85 and 1.74 (d, 3H, rotamers); $^{13}$C NMR (100 MHz, CDCl$_3$) δ 170.20, 168.78, 168.70, 168.36, 167.52, 157.56, 157.48, 157.40, 130.09, 129.70, 129.66, 129.60, 122.32, 122.01, 121.94, 114.61, 114.58, 114.58, 114.39, 91.93, 68.37, 68.25, 67.30, 64.54, 61.25, 46.43, 22.95; R$_f$=0.35 (1:1 EtOAc/hexane).

Compound 99:

Compound 98 (15.15 g, 20.0 mmol) was dissolved in ClCH$_2$CH$_2$Cl (40 mL) and trimethylsilyl trifluoromethanesulfonate (5.43 mL, 30.0 mmol) was added to the stirred solution at r.t. The solution was stirred for 24 h at 50° C., triethylamine (12.6 mL, 90.0 mmol) was added and the mixture was concentrated in vacuo. The resultant was purified by silica gel column chromatography (EtOAc (2.5% Et$_3$N)-hexane) to give slightly impure compound 99 containing tiny amounts of phenoxyacetic acid. This material was used in the next step of the reaction scheme without further purification.

Compound 100:

Compound 99 (3.63 g, 6 mmol) and S-2-hydroxyethyl-4-nitrobenzenesulfonothioate, 54 (2.76 g, 10.5 mmol) were dissolved in ClCH$_2$CH$_2$Cl (18 mL) to give a colorless solution. 4 Å Molecular sieves were added to the stirred solution at r.t. The solution was stirred at r.t. for 30 min then trimethylsilyl trifluoromethanesulfonate (0.543 ml, 3.00 mmol) was added. The mixture was stirred at r.t. for 24 h and TLC showed about 90% reaction completed. Additional 54 (237.0 mg, 0.90 mmol) was added to the mixture and it was stirred for further 36 h to complete the reaction. The mixture was diluted with DCM (100 mL) and washed with sat NaHCO$_3$ (1×100 mL). The aqueous layer was back-extracted with CH$_2$Cl$_2$ (1×50 mL). The combined organic layers were dried with Na$_2$SO$_4$, filtered, concentrated and dissolved in 120 mL of Ac$_2$O-pyridine (1:9, v/v). The mixture was stirred for 12 h then concentrated under reduced pressure. The resultant was diluted with CH$_2$Cl$_2$ (100 mL) and washed with sat NaHCO$_3$ (1×100 mL). The aqueous layer was back extracted with CH$_2$Cl$_2$ (1×50 mL). The combined organic layers were dried with Na$_2$SO$_4$, filtered and concentrated. The resultant was purified by silica gel column chromatography (EtOAc-hexane gradient) to give pure compound 100 (2.56 g, 2.94 mmol, 49.0% yield). $^1$H NMR (399 MHz, CDCl$_3$) δ 8.70-8.62 (d, 2H), 8.41-8.33 (d, 2H), 7.65-7.03 (m, 15H), 6.35-6.27 (d, 1H), 5.81-5.72 (m, 2H), 5.06-4.97 (m, 3H), 4.92-4.85 (m, 2H), 4.83-4.62 (m, 2H), 4.58-4.44 (m, 2H), 4.34-4.26 (m, 2H), 4.26-4.15 (m, 1H), 4.06-3.95 (m, 1H), 3.51-3.40 (m, 2H), 2.22 and 2.18 (d, 3H, rotamers); $^{13}$C NMR (100 MHz, CDCl$_3$) δ 171.17, 169.13, 169.05, 168.92, 157.86, 157.80, 157.76, 150.82, 149.63, 130.01, 129.96, 128.47, 125.06, 122.27, 122.23, 114.93, 114.74, 100.86, 70.64, 70.54, 65.36, 64.90, 62.21, 51.30, 36.54, 23.74; R$_1$=0.60 (1:1 EtOAc/hexane).

Synthesis of Compound 104

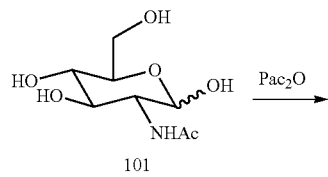

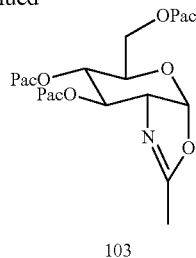

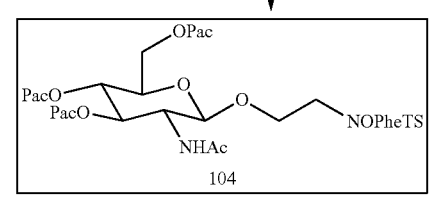

Compound 102:
Using a procedure analogous to that described for compound 98, and substituting compound 101 for compound 97, pure compound 102 is obtained.

Compound 103 Using a procedure analogous to that described for compound 99, and substituting compound 102 for compound 98, pure compound 103 is obtained.

Compound 104 Using a procedure analogous to that described for compound 100, and substituting compound 103 for compound 99, pure compound 103 is obtained.

Synthesis of Compounds 109 and 111

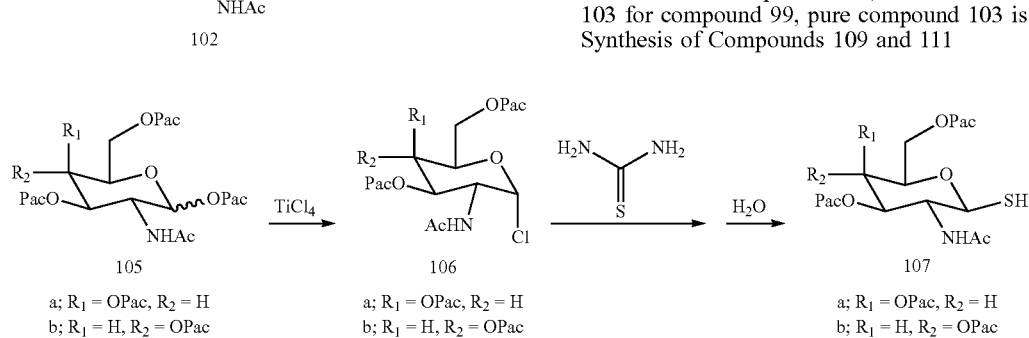

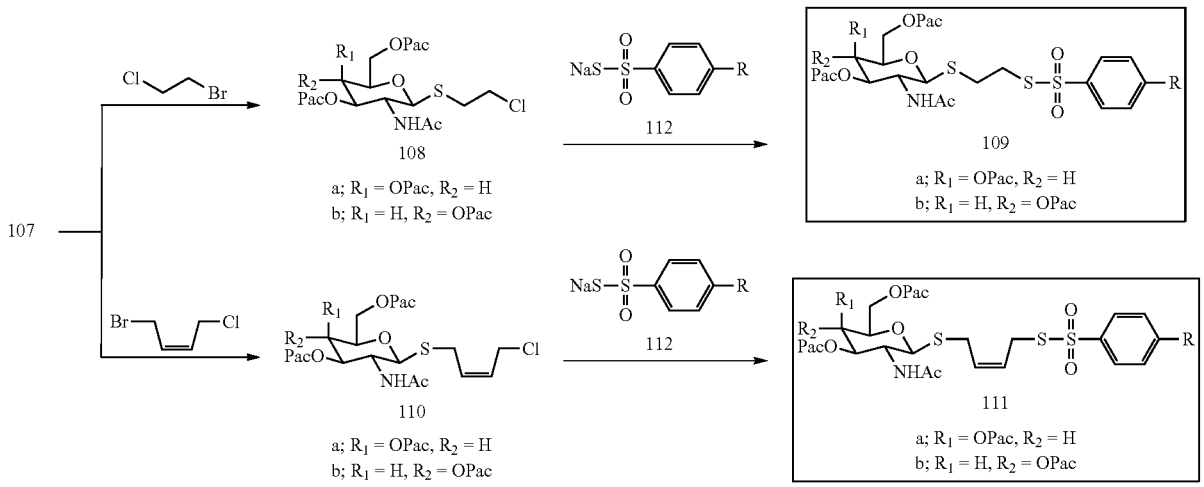

Compound 106:

A solution of compound 105 (100 mmol) in dry 1,2-dichloroethane (300 mL) is treated dropwise via syringe with TiCl₄ (110 mmol) over 2 min. After refluxing for 16 h, TLC shows complete reaction. The crude is diluted with DCM and washed with sat. NaHCO₃. The combined organic layers are dried with Na₂SO₄, filtered, concentrated and used for next reaction without further purification.

Compound 107:

Thiourea (150 mmol) and compound 106 (100 mmol) are dissolved in acetone (200 mL) under Ar. The reaction mixture is heated to 60° C. and stirred. After 2 h, a white solid precipitation is removed by filtration. The precipitate is recrystallized. The filtered crystals and Na₂S₂O₅ (140 mmol) are added to a stirred mixture of DCM (500 mL) and H₂O (250 mL). The reaction mixture is heated to reflux under Ar. After 3 h, the reaction mixture is cooled to r.t. and the phases are separated. The aqueous layer is back extracted with DCM. The combined organic layers are dried over Na₂SO₄, filtered and concentrated to give compound 107.

Compound 108:

1-Bromo-2-chloroethane (100 mmol), triethylamine (200 mmol) and compound 107 (100 mmol) are dissolved in acetonitrile (200 mL) under Ar. The reaction mixture is heated to 60° C. and stirred. TLC shows completed reaction. The mixture is diluted with DCM (500 mL) and washed with NaHCO₃ (250 mL). The organic layer is dried over Na₂SO₄, filtered, concentrated and purified to give compound 108.

Compound 109:

compound 112 (120 mmol), sodium iodide (10.0 mmol) and compound 108 (100 mmol) are dissolved in MeOH (200 mL) under Ar. The reaction mixture is heated to 60° C. and stirred. TLC shows completed reaction. The mixture is diluted with DCM (500 mL) and washed with NaHCO₃ (250 mL). The organic layer is dried over Na₂SO₄, filtered, concentrated and purified to give compound 109.

Compound 110:

1-Bromo-4-chloro-2,3-cis-butene (100 mmol), triethylamine (200 mmol) and compound 107 (100 mmol) are dissolved in acetonitrile (200 mL) under Ar. The reaction mixture is heated to 60° C. TLC shows reaction is completed. The mixture is diluted with DCM (500 mL) and washed with NaHCO₃ (250 mL). The organic layer is dried over Na₂SO₄, filtered, concentrated and purified to give compound 110.

Compound 111:

compound 112 (120 mmol), sodium iodide (10.0 mmol) and compound 110 (100 mmol) are dissolved in MeOH (200 mL) under Ar. The reaction mixture is heated to 60° C. TLC shows completed reaction. The mixture is diluted with DCM (500 mL) and washed with NaHCO₃ (250 mL). The organic layer is dried over Na₂SO₄, filtered, concentrated and purified to give compound 111.

Synthesis of Compound 115

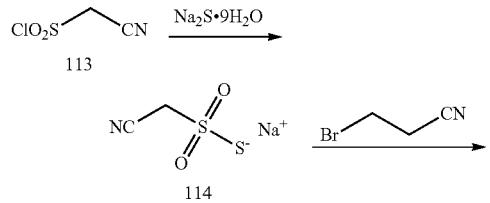

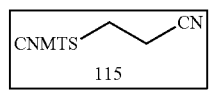

Compound 113:

2-Chlorosulfonylacetonitrile (113) is prepared following the procedure of Sammes (as described in patent GB 1252903).

Compound 114:

Sodium sulfide nonahydrate (65 mmol) is taken up in 100 mL water. The flask is kept in a water bath. Compound 113 (50 mmol) is added dropwise to the solution while stirring and gently warming the water bath. Sulfur is observed to appear and then disappear in the flask. Solvent is evaporated under vacuum and the residue is recrystallized from ethanol. Sodium cyanomethanesulfonothioate (compound 114) is thus obtained as a colorless crystalline solid.

Compound 115:

Compound 114 (13.69 g, 86 mmol) is taken up, with stirring, in anhydrous DMF (30 mL) in a 100 mL round bottom flask. Then, 3-bromopropionitrile (5 mL, 8.2 g, 61.2 mmol) is added and the resulting mixture is stirred for 18 h at 50° C. with monitoring by TLC. On completion of reaction (complete consumption of 3-bromopropionitrile), the reaction mixture is diluted with EtOAc (100 mL) and the organic layer is washed with 5×20 mL H₂O. The organic separated organic layer is then dried (MgSO₄), filtered and reduced to an oil by rotary evaporation. The crude oil is purified by column chromatography using an EtOAc/hexane gradient and the fractions containing pure material are collected and the solvent is removed by rotary evaporation then further drying in vacuo to furnish the pure compound 115 as a colorless oil.

Synthesis of Compound 118

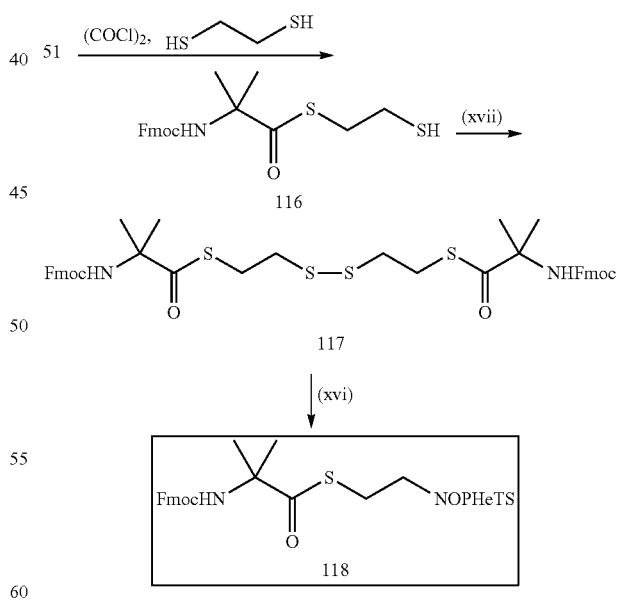

Compound 116:

Compound 51 (2.9 g, 8.91 mmol) in DCM (50 mL) was treated dropwise with oxalyl dichloride (0.53 ml, 6.15 mmol) then DMF (10 µL) and stirred at r.t. During the reaction a colorless homogeneous solution was formed. After 2 h at r.t. the solvent was removed under reduced pressure. The white residue was redissolved in DCM (20 mL) then added dropwise to a stirring pyridine (10 mL) solution of ethane-1,2-dithiol (8.40 g, 89 mmol), with monitoring by UPLC/MS. After 18 h, it was judged that the reaction was complete. The solvents were removed and the remaining ethanethiol was removed by trap-to-trap distillation then the residue was subjected to purification by column chromatography with DCM to provide the pure compound 116 as a colorless solid. Yield was 1.82 g, 51%. MS (ESI +): calc (M+Na)$^+$: 424.10, found: 424.06. $^1$H NMR (500 MHz, CDCl$_3$) δ 7.79 (d, J=7.5 Hz, 2H), 7.63 (d, J=5.7 Hz, 2H), 7.43 (t, J=7.5 Hz, 2H), 7.34 (t, J=7.4 Hz, 2H), 5.40-5.15 (br, 1H), 4.60-4.35 (br, 2H), 4.31-4.19 (m, 1H), 3.15-3.04 (br, 2H), 2.95-2.80 (m, 1H), 2.75-2.60 (br, 2H), 1.72-1.43 (m, 6H); $^{13}$C NMR (126 MHz, CDCl$_3$) δ 203.14, 154.75, 143.92, 141.49, 127.84, 127.19, 125.17, 120.13, 66.81, 62.69, 47.41, 33.01, 25.78, 24.60.

Compound 117:

To a stirred solution of compound 116 (1.7 g, 4.23 mmol) in EtOAc (12 mL) was added sodium iodide (6.35 mg, 0.042 mmol) and hydrogen peroxide (0.144 g, 4.23 mmol) (0.45 mL of a 30% aqueous solution) and the mixture was stirred at r.t. for 15 min. TLC showed complete consumption of the starting material. Aqueous sodium thiosulfate was added until the solution became colorless. The solution was washed with water, dried (MgSO$_4$), then column chromatography (EtOAc/hexane), gave pure compound 117 as a colorless solid foam (1.45 g, 86%). MS (ESI +): calc (M+H)$^+$: 802.07, found: 802.08. $^1$H NMR (500 MHz, CDCl$_3$) δ 7.78 (d, J=7.6 Hz, 4H), 7.63 (d, J=5.8 Hz, 4H), 7.42 (t, J=7.5 Hz, 4H), 7.33 (t, J=7.5 Hz, 4H), 5.42-5.25 (br, 2H), 4.55-4.35 (br, 4H), 4.30-4.18 (br, 2H), 3.25-3.10 (br, 4H), 2.95-2.70 (br, 4H), 1.65-1.45 (br, 12H); $^{13}$C NMR (126 MHz, CDCl$_3$) δ 203.19, 154.71, 143.90, 141.45, 127.80, 127.17, 125.16, 120.10, 66.76, 62.65, 47.37, 37.90, 28.56, 25.73.

Compound 118:

Dibromine (0.091 ml, 1.77 mmol) was added in a dropwise fashion over 2 min to a stirring mixture of sodium 4-nitrobenzenesulfinate (0.742 g, 3.55 mmol) and compound 117 (1.42 g, 1.773 mmol) in DCM (10 mL) at r.t. After 30 min stirring at r.t., the mixture was filtered and the filtrate was reduced to an orange solid foam in vacuo. Column chromatography (DCM/hexane) gave pure compound 118 (1.26 g, 60%) as a pale yellow solid foam. MS (ESI +): calc (M+H)$^+$: 587.71, found: 802.08. $^1$H NMR (500 MHz, CDCl$_3$) δ 8.36 (d, J=8.2 Hz, 2H), 8.14 (d, J=7.3 Hz, 2H), 7.79 (d, J=7.0 Hz, 2H), 7.63 (s, 2H), 7.43 (t, J=6.7 Hz, 2H), 7.35 (d, J=6.8 Hz, 2H), 5.35-5.15 (br, 1H), 4.55-4.35 (br, 2H), 4.30-4.20 (br, 1H), 3.30-3.00 (br, 4H), 1.70-1.25 (br, 6H); $^{13}$C NMR (126 MHz, CDCl$_3$) δ 202.71, 154.66, 150.60, 149.63, 143.78, 141.46, 128.40, 127.91, 127.21, 125.12, 124.81, 120.18, 66.86, 62.59, 47.35, 35.84, 28.42, 25.61.

Synthesis of Compound 120

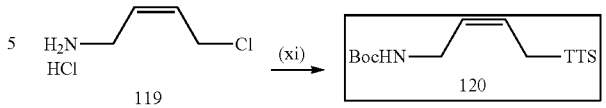

Compound 120:

Commercially available compound 119 (1 g, 7.04 mmol) and potassium 4-methylbenzenesulfonothioate (1.753 g, 7.75 mmol) were stirred in MeOH (10 mL) over 5 days at r.t. then at 40° C. over 24 h. TLC showed good conversion to product. The MeOH was evaporated and the residue was taken up in DCM (30 mL) and Boc$_2$O (1.54 g, 7.04 mmol) was added. The mixture was treated with triethylamine (1.030 ml, 7.39 mmol) in a dropwise fashion over 10 min at r.t. until the solution became practically homogeneous. Washing with water (50 mL), drying (MgSO$_4$), filtration and evaporation gave the crude product which was further purified by column chromatography to give pure compound 120 (1.64 g, 65%) as a colorless solid. MS (ESI +): calc (M+Na)$^+$: 380.10, found: 380.11. $^1$H NMR (399 MHz, CDCl$_3$) δ 7.80 (d, J=8.2 Hz, 2H), 7.34 (dd, J=8.5, 0.8 Hz, 2H), 5.54 (ddt, J=24.7, 16.6, 7.9 Hz, 2H), 4.65 (s, 1H), 3.77-3.66 (m, 4H), 2.45 (s, 3H), 1.43 (s, 9H); $^{13}$C NMR (100 MHz, CDCl$_3$) δ 155.83, 145.05, 142.06, 131.80, 130.01, 127.15, 124.55, 79.72, 37.29, 32.75, 28.51, 21.79.

Synthesis of Compound 122

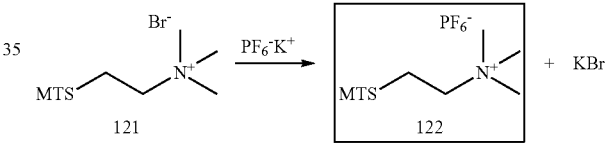

Compound 122:

A solution of commercially available compound 121 (1 g, 3.59 mmol) in water (1 mL) was treated all at once with a solution of potassium hexafluorophosphate (0.662 g, 3.59 mmol) in water (10 mL) and agitated by shaking at r.t. for 5 min. The resulting solid was collected by filtration, washed with 2×3 mL water and dried in vacuo over KOH to give pure compound 122 as a colorless solid (1.01 g, 82%). $^1$H NMR (300 MHz, CD$_3$CN) δ 3.67-3.60 (m, 2H), 3.49 (s, 3H), 3.53-3.45 (m, 2H), 3.10 (s, 9H); $^{13}$C NMR (126 MHz, CD$_3$CN) δ 65.98, 54.05 (q, J=4.1 Hz), 51.11, 28.99; $^{19}$F NMR (376 MHz, CD$_3$CN) δ −73.15 (d, J=706.5 Hz); $^{31}$P NMR (162 MHz, CD$_3$CN) δ −143.50 (hept, J=706.6 Hz).

Synthesis of Compound 125

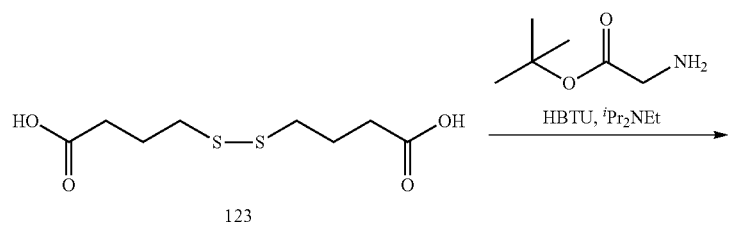

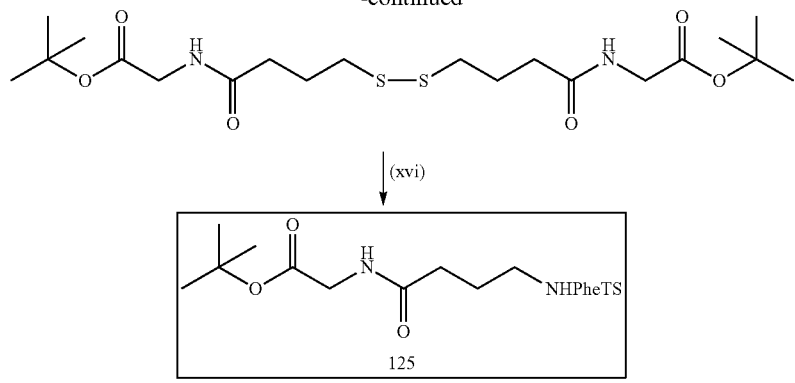

↓ (xvi)

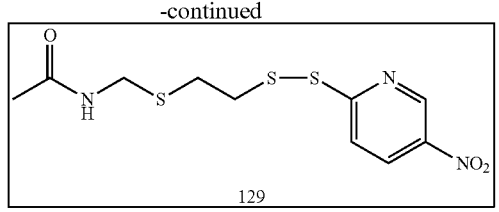

Compound 124:

A DMF (50 mL) solution of commercially available compound 123 (10 mmol) is treated successively with tert-butyl-2-aminoacetate (22 mmol), di-isopropylethylamine (50 mmol) and HBTU (24 mmol). After 1 h stirring at r.t., water (100 mL) is added and the resulting solution is extracted with EtOAc (2×50 mL) and washed with 5% NaHCO$_3$ (2×25 mL) then dilute brine (2×25 mL), dried (MgSO$_4$), filtered and reduced by rotary evaporation. Purification by column chromatography provides the pure compound 124.

Compound 125:

Dibromine (0.091 ml, 1.77 mmol) is added in a dropwise fashion over 2 min to a stirring mixture of sodium 4-nitrobenzenesulfinate (0.742 g, 3.55 mmol) and di-tert-butyl-2,2'-((4,4'-disulfanediyl-bis(butanoyl))bis(azanediyl))diacetate (824 mg, 1.77 mmol) in DCM (10 mL) at r.t. After 30 min stirring at r.t., the mixture is filtered and the filtrate is reduced to a solid foam in vacuo. Column chromatography gives the pure product as a solid foam.

Synthesis of Compound 129

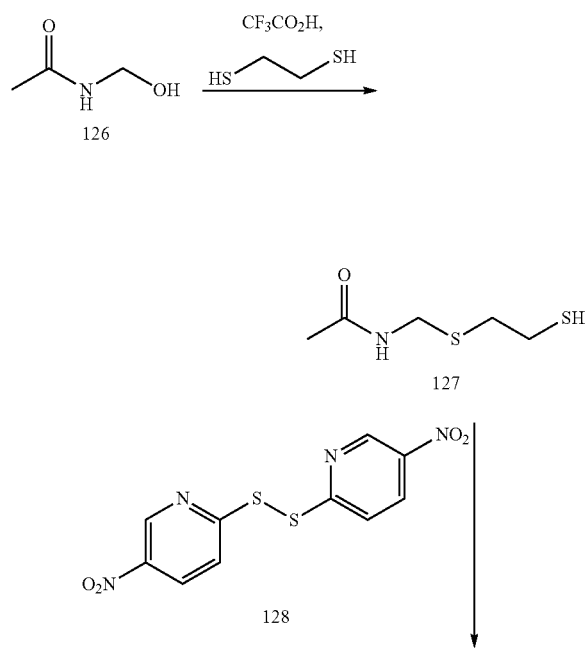

Compound 127:

A solution of ethane-1,2-dithiol (1.130 g, 12 mmol) in TFA (10 mL) was treated all at once with commercially available compound 126 (0.89 g, 9.99 mmol). The solution became warm. After 1 h stirring at r.t. the volatiles were removed and the residue was subjected to column chromatography to give pure compound 127 as a colorless oil (0.95 g, 48%). $R_f$=0.6 (5% MeOH/DCM); $^1$H NMR (500 MHz, CDCl$_3$) δ 6.09-5.93 (br, 1H), 4.41 (d, J=6.4 Hz, 2H), 2.87-2.83 (m, 2H), 2.79 (ddd, J=9.7, 7.3, 3.5 Hz, 2H), 2.04 (s, 3H), 1.71 (t, J=8.0 Hz, 1H); $^{13}$C NMR (126 MHz, CDCl$_3$) δ 170.25, 40.89, 35.22, 24.91, 23.44.

Compound 129:

A warm (35° C.) DMF (10 mL) solution of commercially available compound 128 (939 mg, 3.0 mmol) was treated in a dropwise fashion over 5 min with a DCM (5 mL) solution of compound 127 (250 mg, 1.513 mmol). After checking TLC, the solvents were removed by rotary evaporation under high vacuum then the residue was triturated with DCM (50 mL), filtered, and the filtrate was washed with 5×5% NaHCO$_3$, then was dried (MgSO$_4$), filtered and reduced to a pale yellow solid. Column chromatography gave pure compound 129 as a pale yellow solid. MS (ESI +): calc (M+H)$^+$: 320.02, found: 320.34; $^1$H NMR (500 MHz, CDCl$_3$) δ 9.28 (dd, J=2.7, 0.7 Hz, 1H), 8.43 (dd, J=8.9, 2.6 Hz, 1H), 7.93 (dd, J=8.9, 0.7 Hz, 1H), 6.10-5.90 (br, 1H), 4.41 (d, J=6.5 Hz, 2H), 3.13 (dd, J=8.6, 6.3 Hz, 2H), 2.93 (dd, J=8.6, 6.4 Hz, 2H), 2.00 (s, 3H); $^{13}$C NMR (126 MHz, CDCl$_3$) δ 170.18, 168.57, 145.22, 142.22, 131.81, 119.59, 40.65, 38.59, 30.07, 23.39.

Synthesis of Compound 134

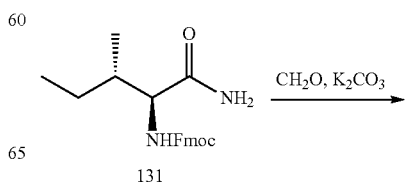

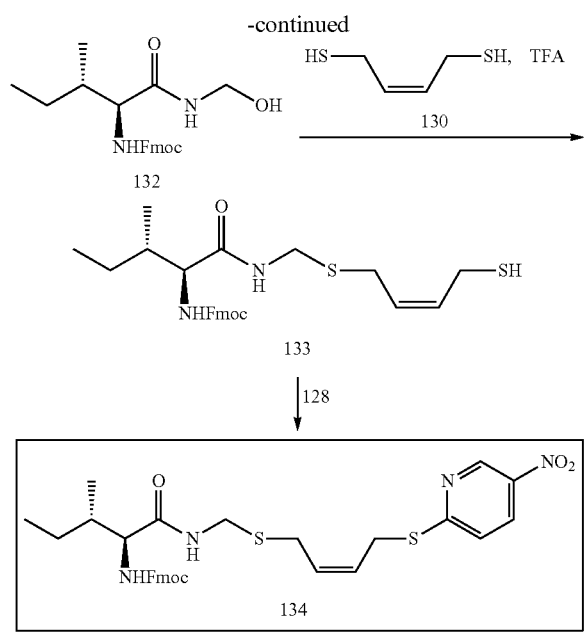

Compound 130:

Compound 130 is prepared by a previously described method (Heterocycles, Vol 54, p 139, 2001).

Compound 132:

Using an analogous procedure described previously for the synthesis of compound 126 (Organic Syntheses, Coll. Vol. 6, p. 5 (1988)), compound 131 (Tetrahedron Letters, 48(39), 7038-7041; 2007) is converted to compound 132 by gently heating in the presence of an aqueous formaldehyde solution containing $K_2CO_3$.

Compound 133:

Using a procedure analogous to that described for the synthesis of compound 127 and substituting compound 132 for compound 126 and compound 130 for ethane-1,2-dithiol, pure compound 133 is thus obtained.

Compound 134:

Using a procedure analogous to that described for the synthesis of compound 129 and substituting compound 133 for compound 127, pure compound 134 is thus obtained.

Synthesis of Compound 140

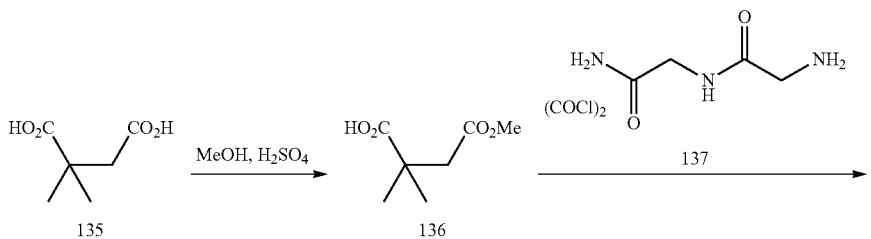

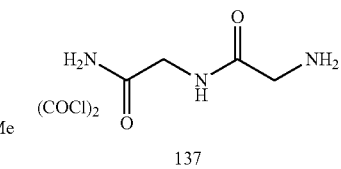

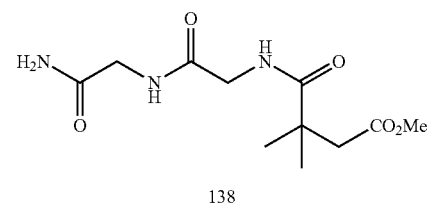

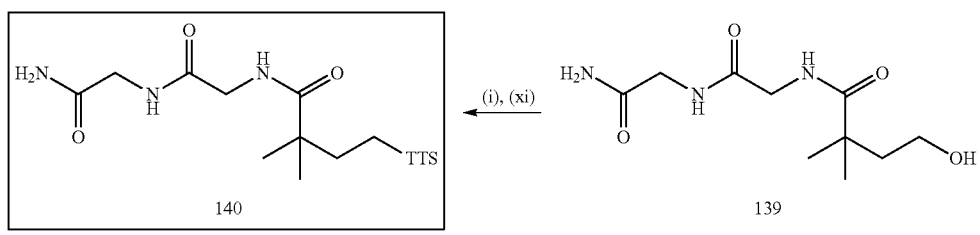

Compound 136:

An ice-cold solution of commercially available compound 135 (50 g, 342 mmol), and methanol (277 mL) was treated dropwise with sulfuric acid (3.36 g, 34.2 mmol) over 10 min then warmed to r.t. gradually overnight. Most of the solvent was removed by rotary evaporation, then saturated aqueous NaHCO$_3$ was carefully added. The pH of the solution was adjusted to 1.9 by addition of 1 M HCl then extracted into EtOAc (200 mL), washed with diluted brine (50 mL), dried (MgSO$_4$), filtered and reduced to 29 g of colorless oil. Column chromatography gave pure compound 136 as a colorless solid (12.5 g, 23%). H NMR (500 MHz, CDCl$_3$) δ 12.5-10.5 (vbr, 1H), 3.69 (s, 3H), 2.63 (s, 2H), 1.32 (s, 6H); $^{13}$C NMR (126 MHz, CDCl$_3$) δ 183.32, 171.76, 51.72, 43.88, 40.60, 25.34.

Synthesis of compound 138: Compound 136 (10 mmol) in DCM (50 mL) is treated dropwise with oxalyl dichloride (10 mmol) then DMF (10 µL) and stirred at r.t. During the reaction a colorless homogeneous solution is formed. After 2 h at r.t. the solvent is removed under reduced pressure. The white residue is redissolved in DCM (20 mL) then added dropwise to a stirring pyridine (10 mL) solution of compound 137 (10 mmol), with monitoring by TLC. After 18 h, the solvents are removed and the residue is subjected to purification by column chromatography with DCM to provide the pure compound 137.

Compound 139:

Compound 138 (5 mmol) as a solution in THF (20 mL) is added to an ice-cold solution of LiBH$_4$ (5 mmol) in THF (20 mL). Progress of the reaction at r.t. is judged by TLC. After completion of the reaction (complete consumption of starting material), water (100 mL) is added carefully to the ice-cold solution which is subsequently extracted with EtOAc (2×100 mL). The combined organic extracts are dried (MgSO$_4$), filtered and the solvents are removed by rotary evaporation. The residue is subjected to column chromatography the pure compound 139 is thus obtained.

Compound 140:

Using a procedure analogous to that described for the synthesis of compound 80, and substituting compound 139 for compound 79, pure compound 140 is thus obtained.

Synthesis of Compound 143

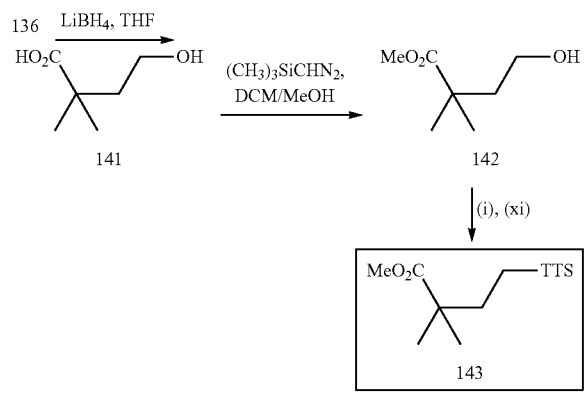

Compound 139:

Using a procedure analogous to that described for the synthesis of compound 139 and substituting compound 136 for compound 138, pure compound 141 is thus obtained.

Compound 142:

A solution of compound 141 (8.39 mmol) in DCM/MeOH (12/3 mL) is treated dropwise at 0° C. with a 2 M solution of (diazomethyl)trimethylsilane (1.05 g, 9.23 mmol) in ether over 30 min. After quenching excess reagent with AcOH, washing with water (2×5 mL), drying (MgSO$_4$), filtration, removal of solvent by rotary evaporation, then column chromatography the pure compound 142 is obtained.

Compound 143:

Using a procedure analogous to that described for the synthesis of compound 80, and substituting compound 142 for compound 79, pure compound 143 is thus obtained.

Synthesis of Compound 147

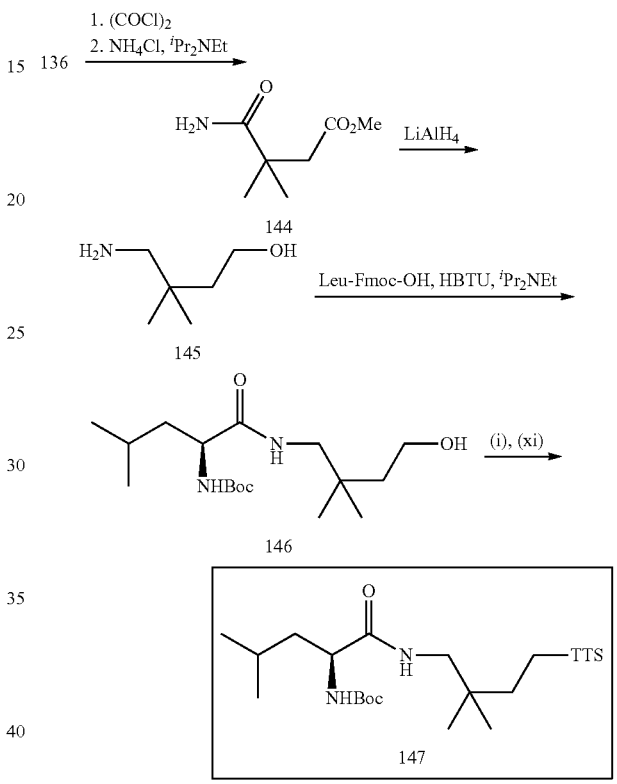

Compound 144:

Using a procedure analogous to that described for the synthesis of compound 69a, and substituting compound 136 for compound 67, and compound 54 for NH$_4$Cl plus iPr$_2$NEt, pure compound 144 is thus obtained.

Compound 145:

LiAlH$_4$ (100 mL of a 2 M solution in THF) is added in a dropwise fashion to an ice-cold THF (500 mL) solution of compound 144 (86 mmol). The mixture is warmed to r.t. then refluxed for 0.5 h. The residual LiAlH$_4$ is destroyed by careful addition of saturated Na$_2$SO$_4$ to the ice-cold solution until a granular precipitate is formed. The mixture is filtered and reduced then redissolved in EtOAc, dried (MgSO4), filtered and reduced in vacuo to furnish compound 145 which is sufficiently pure for direct use in the next step of the reaction.

Compound 146:

Using a procedure analogous to that described for the synthesis of compound 124, and substituting compound 145 for compound 123, and Leu-Fmoc-OH for tert-butyl 2-aminoacetate, pure compound 146 is thus obtained.

Compound 147:

Using a procedure analogous to that described for the synthesis of compound 80, and substituting compound 146 for compound 79, and compound 114 for potassium 4-methylbenzenesulfonothioate, pure compound 147 is thus obtained.

Synthesis of Compound 150

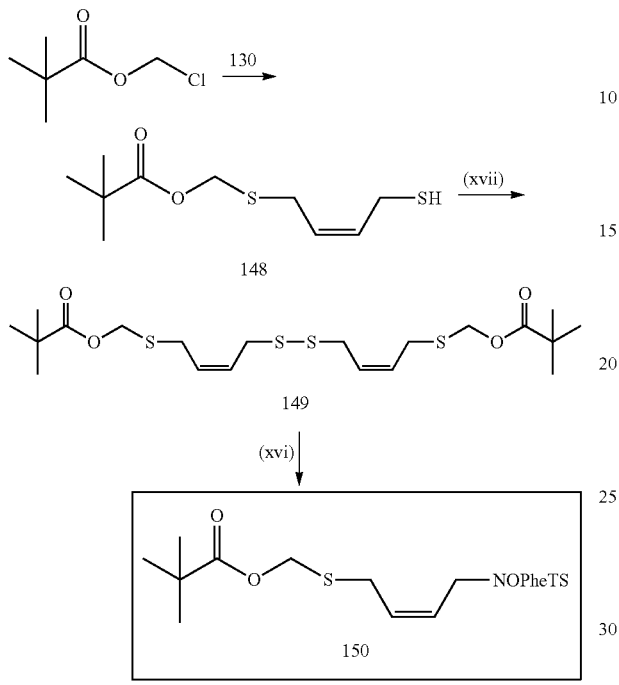

Compound 148:

Commercially available chloromethyl pivalate (10 mmol) is added in a dropwise fashion to a stirring solution of compound 130 (20 mmol) in 1,2-dichloroethane (100 mL) under Ar. The resulting solution is heated in order to force to completion (noted by disappearance of chloromethylpivalate material by TLC). Solvent is removed by rotary evaporation, then the residue is subjected to column chromatography to provide the pure compound 148.

Compound 149:

Using a procedure analogous to that described for the synthesis of compound 89, and substituting compound 148 for compound 88, pure compound 149 is thus obtained.

Compound 150:

Using a procedure analogous to that described for the synthesis of compound 87, and substituting compound 149 for compound 86, pure compound 150 is thus obtained.

Additional Sulfurization Reagents:

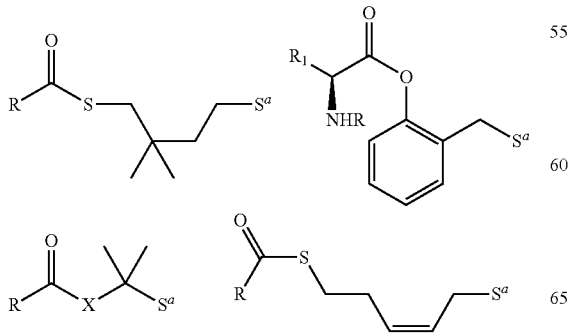

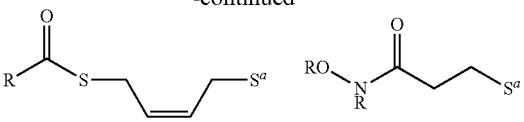

wherein $S^a$ denotes any of the following structures:

NOPheTS = 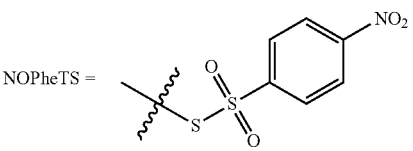

TTS = 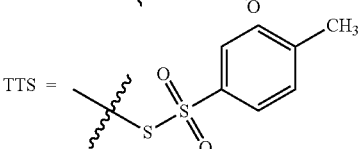

p-ClPheTS = 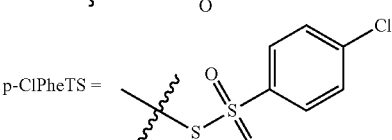

m-ClPheTS = 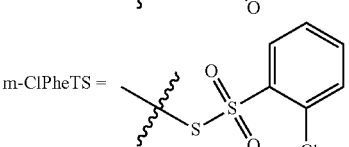

2,4,6-TriClPheTS = 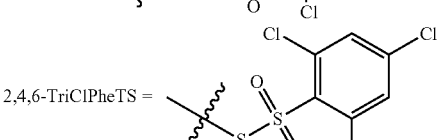

PheTS = 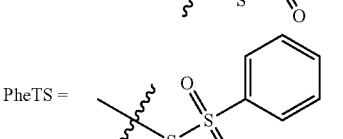

PFPheTS = 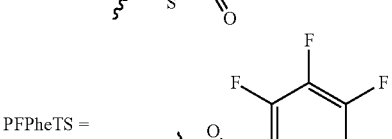

MTS = 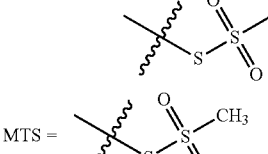

α-CNMTS = 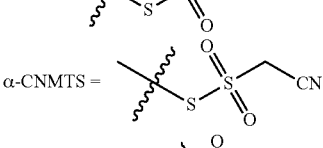

α-NO2MTS = 

Synthesis of Phosphoramidites

In some embodiments, the present invention provides phosphoramidites, and methods of making the same. In some embodiments, the provided phosphoramidites were used in the synthesis of oligonucleotides described in the present application. Exemplary phosphoramidites and their synthesis are described below.

Synthesis of Compound 203

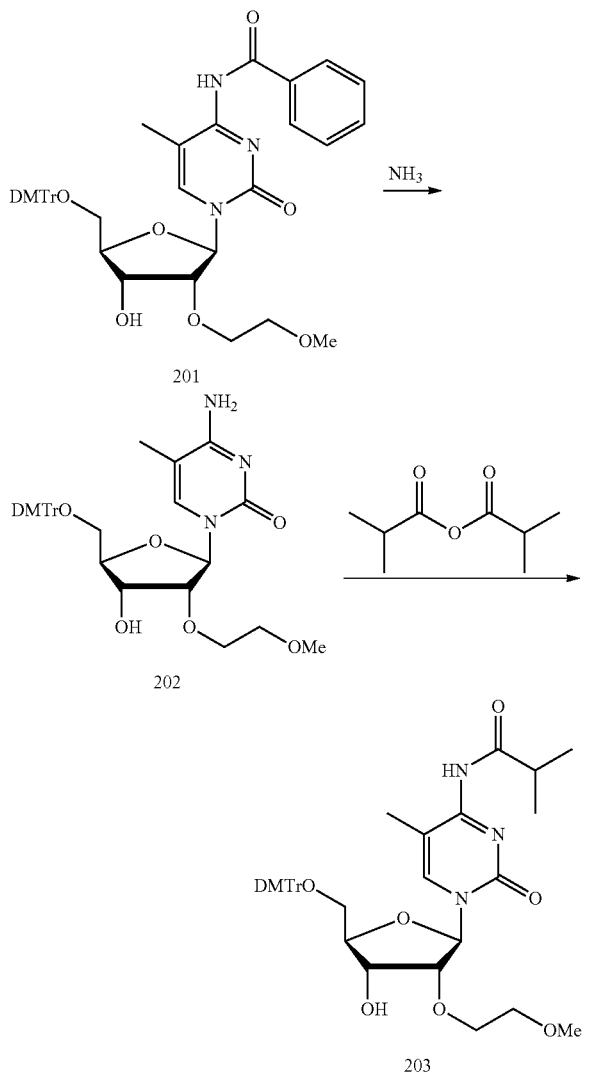

in DMF (13 ml) at r.t. The solution was allowed to stir at r.t. over 24 h then the solvent was removed in vacuo at 35° C. Extraction into ether/bicarbonate then drying (MgSO$_4$), filtration and removal of the solvent gave the crude product as a colorless solid foam. Column chromatography (0-4% MeOH/DCM) gave the pure product (1.75 g, 98%) as a colorless solid foam which was homogenous by TLC and HPLC. (ESI +): calc (M+H)$^+$: 688.32, found: 688.56. $^1$H NMR (399 MHz, CDCl$_3$) δ 8.00-7.75 (br, 1H), 7.45-7.39 (m, 2H), 7.34-7.20 (m, 8H), 6.84 (dd, J=9.0, 1.2 Hz, 4H), 5.97 (s, 1H), 4.43 (d, J=6.1 Hz, 1H), 4.20-4.04 (m, 3H), 3.79 (d, J=0.9 Hz, 6H), 3.64-3.58 (m, 1H), 3.64-3.52 (m, 2H), 3.47-3.40 (m, 2H), 3.38 (s, 3H), 1.70-1.55 (br, 1H), 1.39 (d, J=1.0 Hz, 3H), 1.18 (d, J=6.9 Hz, 6H).

Synthesis of Compound 205

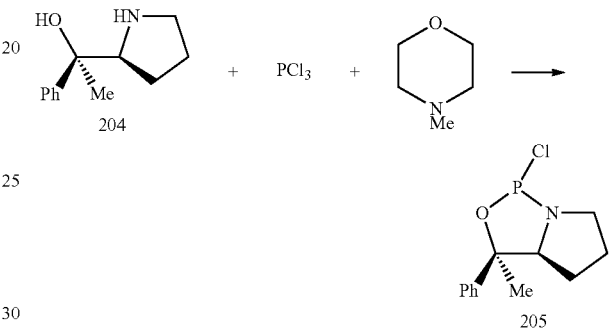

Compound 205:

(R)-1-phenyl-1-((S)-pyrrolidin-2-yl)ethanol (4) was dried by azeotropic distillation with toluene (3×3 mL). A solution dried compound 4 (0.725 g, 3.79 mmol) and 4-methylmorpholine (0.833 ml, 7.58 mmol) in toluene (5 mL) was added to an ice-cold solution of trichlorophosphine (0.331 ml, 3.79 mmol) in toluene (5 mL) which was then warmed to r.t. for 1 h then filtered under Ar and reduced to an oil which was used in the next step of the reaction without further purification.

Synthesis of Compound 207

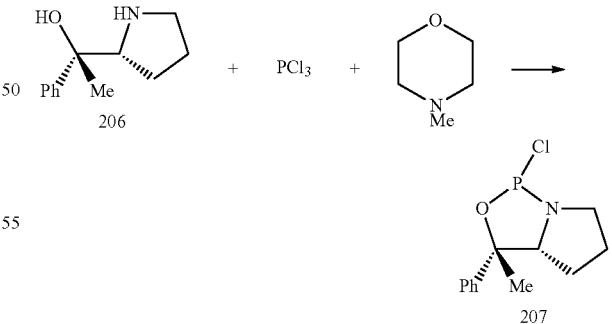

Compound 202:

N$^4$-Bz-5'-O-DMTr-2'-O-MOE-5-methylcytidine (201) (2.00 g, 2.77 mmol) was treated with 2 M ammonia in 2-propanol (Aldrich, anhydrous, 45 mL) and Pyridine (22.5 mL) at 60° C. for 5 h then at r.t. overnight, with monitoring by TLC and UPLC/MS. Solvent was removed (3× azeotrope with toluene) then column chromatography (0-10% MeOH/DCM) gave the pure compound 202 (1.62 g, 95%) as a colorless solid which was homogeneous by TLC and HPLC. (ESI +): calc (M+H)$^+$: 618.28, found: 618.53. $^1$H NMR (399 MHz, CDCl$_3$) δ 7.82 (d, J=1.3 Hz, 1H), 7.47-7.40 (m, 2H), 7.37-7.18 (m, 8H), 6.83 (dd, J=8.9, 1.7 Hz, 4H), 5.93 (d, J=1.1 Hz, 1H), 4.43 (td, J=8.3, 4.9 Hz, 1H), 4.24 (ddd, J=11.7, 5.1, 3.0 Hz, 1H), 4.07 (dt, J=8.6, 2.4 Hz, 1H), 4.03-3.98 (m, 1H), 3.90 (ddd, J=11.7, 6.3, 3.3 Hz, 1H), 3.79 (d, J=1.0 Hz, 6H), 3.63-3.52 (m, 3H), 3.44 (dd, J=11.0, 3.0 Hz, 1H), 3.37 (s, 3H), 3.32 (d, J=9.4 Hz, 1H), 1.80-1.64 (s, br, 1H), 1.13 (s, 3H).

Compound 203:

Isobutyric anhydride (0.48 ml, 2.9 mmol) was added dropwise to a solution of compound 202 (1.61 g, 2.61 mmol)

Compound 207:

Using a procedure analogous to that described for the synthesis of compound 205, and substituting compound 206 for compound 204, compound 207 was obtained as a crude brown oil and was used in the next step of the reaction without further purification.

Synthesis of Compound 208

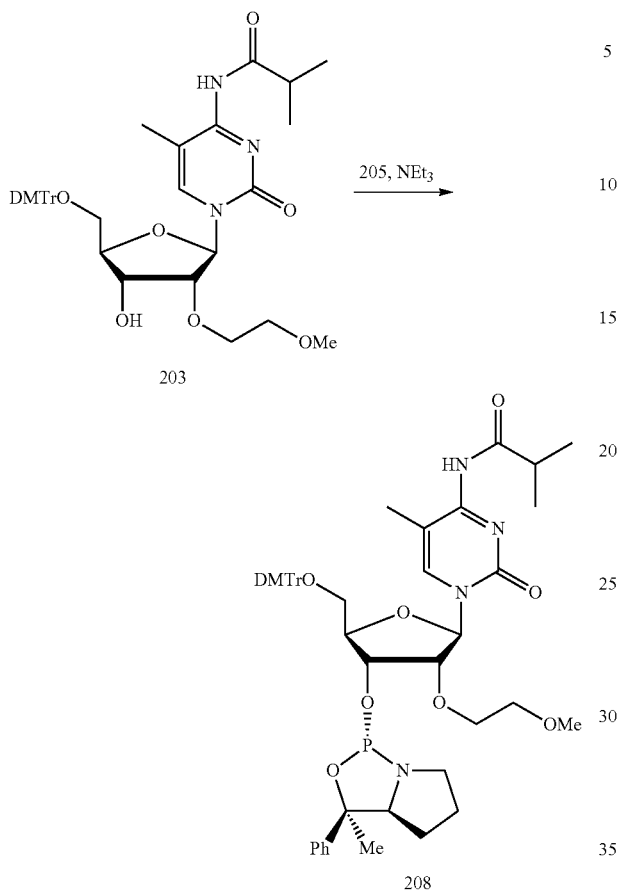

Compound 208:

Compound 203 (1.74 g, 2.53 mmol) was dried by coevaporation with pyridine (3×5 mL) then toluene (5×5 mL). The resulting dried 203 was dissolved in THF (15 mL), then triethylamine (2.47 ml, 17.7 mmol) was added and the solution was cooled to −78° C. by means of $CO_2$(s)/acetone cooling bath. A THF solution (15 mL) of the crude compound 205 (3.79 mmol) was added dropwise over 0.5 h then gradually warmed to r.t. After 1 h at r.t., TLC indicated complete conversion of compound 203 to product. The mixture was washed into a separation funnel with chloroform (100 mL) then was extracted with $NaHCO_3$ (saturated, aqueous, 50 mL then 2×25 mL). At each extraction, the aqueous extracts were washed with an additional 1×10 mL of chloroform. The combined chloroform extracts were dried ($MgSO_4$), filtered, and concentrated by rotary evaporation at 32° C. The crude solid thus obtained was redissolved in DCM containing a few drops of triethylamine then subjected to column chromatography with a hexane/EtOAc gradient containing a steady concentration of 2% triethylamine to give pure compound 208 as a white solid foam. $^1$H NMR (399 MHz, $CD_3CN$) δ 7.92-7.80 (s, 1H), 7.52-7.47 (m, 2H), 7.40-7.24 (m, 12H), 6.88 (dd, J=9.0, 1.1 Hz, 4H), 5.94 (d, 0.1=3.9 Hz, 1H), 4.79 (dt, J=9.6, 5.6 Hz, 1H), 4.31-4.27 (m, 1H), 4.27-4.22 (m, 1H), 3.87 (t, J=4.7 Hz, 2H), 3.75 (d, J=2.0 Hz, 6H), 3.66 (td, J=5.9, 5.5, 2.2 Hz, 1H), 3.58-3.53 (m, 2H), 3.50 (dd, J=11.1, 2.4 Hz, 1H), 3.38 (dd, J=11.0, 3.3 Hz, 1H), 3.31 (s, 3H), 2.85 (dq, J=10.5, 7.4, 6.9 Hz, 2H), 1.73 (s, 3H), 1.52 (d, J=1.0 Hz, 3H), 1.47-1.32 (m, 2H), 1.17 (dd, J=6.9, 0.7 Hz, 6H), 1.05-0.90 (m, 2H); $^{31}$P NMR (162 MHz, $CD_3CN$) δ 155.35.

Synthesis of Compound 210

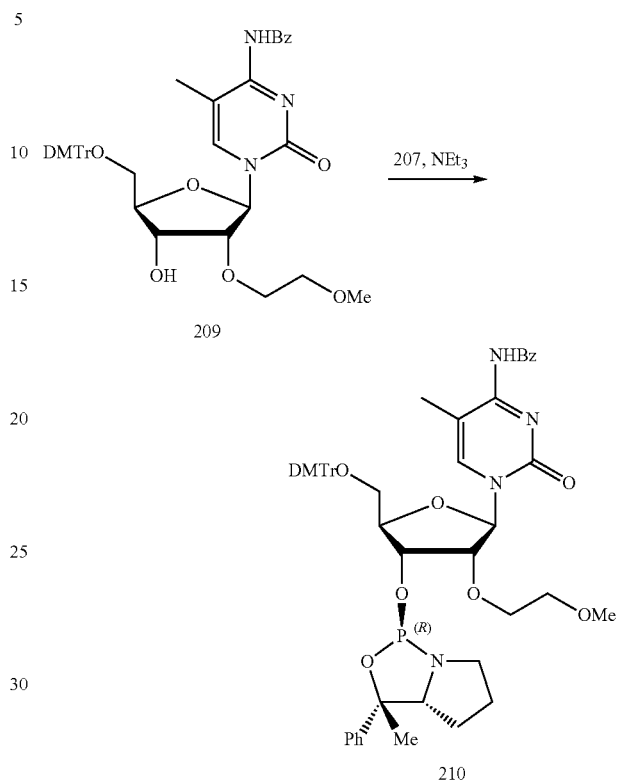

Compound 210:

Using a procedure analogous to that described for compound 208 and substituting compound 209 for compound 203 and compound 207 for compound 205, pure compound 210 was obtained as a colorless solid foam. $^1$H NMR (399 MHz, $CD_3CN$) δ 8.31-8.27 (m, 2H), 7.86 (d, J=1.2 Hz, 1H), 7.62-7.55 (m, 1H), 7.55-7.45 (m, 5H), 7.44-7.24 (m, 12H), 6.94-6.90 (m, 4H), 5.96 (d, J=3.7 Hz, 1H), 4.86-4.76 (m, 1H), 4.29 (dd, J=5.0, 3.8 Hz, 1H), 4.23 (dt, J=5.8, 2.8 Hz, 1H), 3.92-3.80 (m, 2H), 3.78 (s, 6H), 3.74 (ddd, J=7.1, 5.3, 2.1 Hz, 1H), 3.55 (t, J=4.7 Hz, 2H), 3.51 (d, J=2.3 Hz, 1H), 3.41 (dd, J=11.1, 3.4 Hz, 1H), 3.30 (s, 3H), 3.26 (ddd, J=10.3, 6.1, 2.2 Hz, 1H), 2.86 (ddt, J=10.1, 8.2, 7.2 Hz, 1H), 1.72 (d, J=0.7 Hz, 3H), 1.62 (d, J=1.1 Hz, 3H), 1.56-1.41 (m, 2H), 1.09-0.87 (m, 2H); $^{31}$P NMR (162 MHz, $CD_3CN$) δ 155.22.

Synthesis of Compound 212

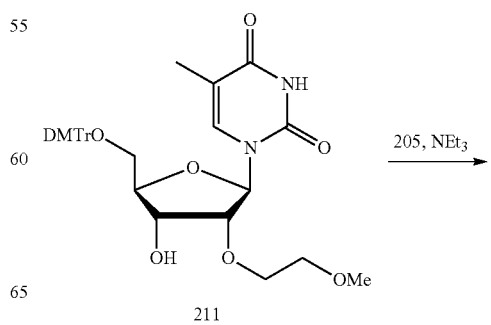

Synthesis of Compound 215

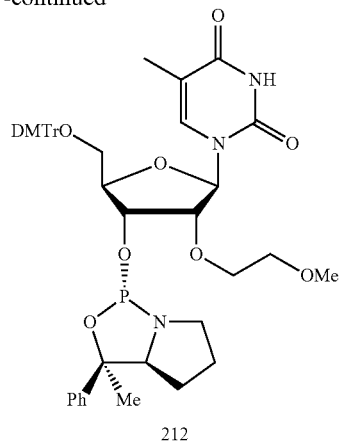

212

Compound 212:

Using a procedure analogous to that described for compound 208 and substituting compound 211 for compound 203, pure compound 212 was obtained as a colorless solid foam. $^1$H NMR (399 MHz, CDCl$_3$) δ 9.25-8.70 (br, 1H), 7.69 (d, J=1.3 Hz, 1H), 7.46-7.40 (m, 2H), 7.40-7.17 (m, 12H), 6.81 (dd, J=9.0, 2.5 Hz, 4H), 6.09 (d, J=4.3 Hz, 1H), 4.78 (dt, J=9.6, 5.2 Hz, 1H), 4.36-4.26 (m, 2H), 3.94-3.88 (m, 2H), 3.74 (dd, J=4.0, 0.9 Hz, 6H), 3.69 (td, J=6.4, 2.9 Hz, 1H), 3.64-3.56 (m, 3H), 3.44-3.37 (m, 2H), 3.36 (d, J=0.9 Hz, 3H), 3.00 (dtd, J=10.3, 7.9, 6.4 Hz, 1H), 1.72 (s, 3H), 1.54-1.44 (m, 1H), 1.38 (dd, J=6.8, 5.4 Hz, 1H), 1.34 (d, J=1.2 Hz, 3H), 1.23-1.13 (m, 1H), 0.97-0.87 (m, 1H); $^{31}$P NMR (162 MHz, CDCl$_3$) δ 158.18.

Synthesis of Compound 213

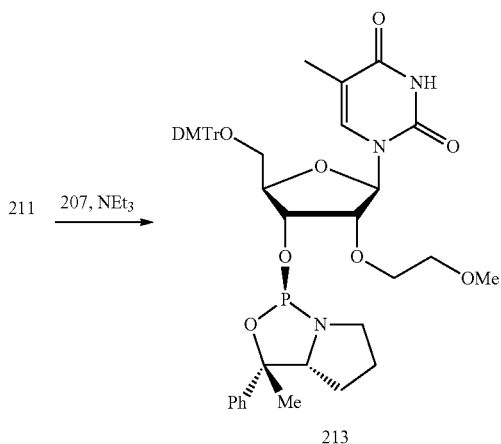

Compound 213:

Using a procedure analogous to that described for compound 210 and substituting compound 211 for compound 209, pure compound 213 was obtained as a colorless solid foam. H NMR (399 MHz, CDCl$_3$) δ 9.55-9.10 (br, 1H), 8.09 (d, J=1.5 Hz, 1H), 7.80-7.71 (m, 2H), 7.69-7.47 (m, 12H), 7.20-7.08 (m, 4H), 6.32 (d, J=2.9 Hz, 1H), 5.20-5.11 (m, 1H), 4.66-4.59 (m, 1H), 4.49-4.39 (m, 1H), 4.33-4.24 (m, 1H), 4.16-4.02 (m, 8H), 4.00-3.93 (m, 1H), 3.91-3.84 (m, 2H), 3.73 (dd, J=11.0, 2.5 Hz, 1H), 3.65-3.52 (m, 4H), 3.27-3.16 (m, 1H), 2.15 (s, 3H), 1.88-1.76 (m, 1H), 1.76-1.65 (m, 1H), 1.63-1.49 (m, 4H), 1.29-1.18 (m, 1H); $^{31}$P NMR (162 MHz, CDCl$_3$) δ 160.08.

Synthesis of Compound 215

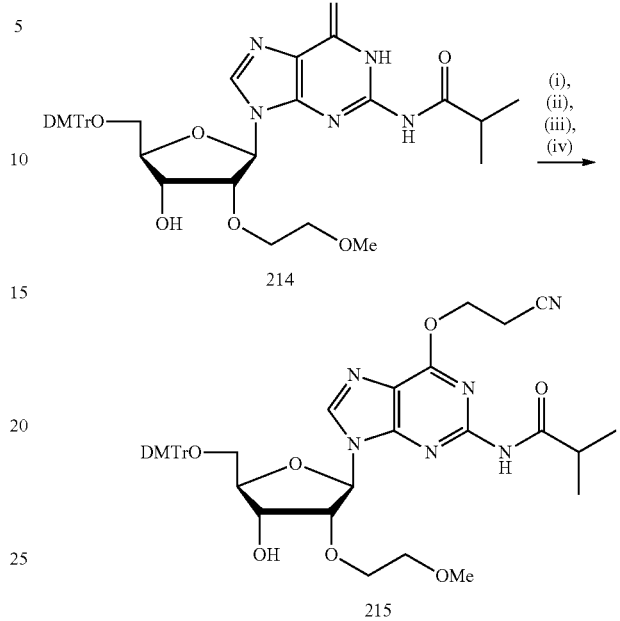

(i) TMSCl, NEt3, 0° C.; (ii) 2,4,6-trimethylbenzene-1-sulfonyl chloride, DMAP; (iii) 1-methylpyrrolidine, 3-hydroxypropanenitrile, DBU, 0° C.; (iv) MeOH/H2O, 4 d, room temperature

Compound 215:

(i) Transient TMS Protection: A solution of N$^2$-isobutyryl-5'-O-DMTr-2'-O-MOE-guanosine (compound 214) (15.04 g, 21.1 mmol) and triethylamine (11.8 ml, 85 mmol) was taken up in ACN (200 mL) then chlorotrimethylsilane (10.4 ml, 82 mmol) was added dropwise to the ice-cold solution which was stirred at r.t. for 1 h with monitoring by TLC. Filtration and removal of solvent, then extraction (DCM/NaHCO$_3$ 500 mL/200 mL), drying (MgSO$_4$), filtration, and removal of the solvent gave the crude compound which was used in the next step of the reaction without further purification. The compound was homogeneous by TLC (R$_f$=0.6, (5% MeOH/DCM)). (ii) Activation of O$^6$ position for Cyanoethyl protection: The residue was redissolved in DCM (500 mL) then triethylamine (13.1 ml, 94 mmol) was added, followed by 2,4,6-trimethylbenzene-1-sulfonyl chloride (6.15 g, 28.1 mmol) and DMAP (0.14 g, 1.146 mmol). The mixture was stirred at r.t. for 3 h with monitoring by TLC until full disappearance of the starting material and emergence of a new spot by TLC (R$_f$=0.9, (5% MeOH/DCM)). (iii) Cyanoethyl protection: 1-methylpyrrolidine (22.43 ml, 211 mmol) was added slowly in a dropwise fashion to the ice-cold solution with further reaction at 0° C. over 1 h, monitoring by TLC (new spot, R$_f$=0.2, streak, (5% MeOH/DCM)). 3-hydroxypropanenitrile (14.40 ml, 211.0 mmol) then DBU (6.32 mL, 42.1 mmol) were added in a dropwise fashion successively to the still ice-cold solution and stirring was continued for additional 90 min, monitoring by TLC (new spot, R$_f$=0.6, (5% MeOH/DCM)). In order to force the reaction almost to completion, a further 1.6 mL of DBU was added dropwise with careful monitoring by TLC. The mixture was poured onto NaH$_2$PO$_4$ (50 g in 400 mL water), the organics were separated, and washed with dilute NaH$_2$PO$_4$ (10 g in 200 mL water), dried (MgSO$_4$), filtered and reduced by rotary evaporation. (iv) TMS Deprotection: The residue thus obtained in the previous step was redissolved in MeOH (250 mL) then water was added in a dropwise fashion being careful not to induce precipitation. The dropwise addition was continued over 4 days with monitoring by TLC. Most of the solvent was removed and the residue was extracted (DCM/NaHCO$_3$ (500/200 mL), filtered and reduced. The residue was subjected to column purification (0-5% MeOH/DCM) to give pure compound 215 as a white foam which was homogeneous by TLC and HPLC. (ESI +): calc (M+H)$^+$: 767.34, found: 767.03. $^1$H NMR (300 MHz, CD$_3$CN) a 8.63 (s, 1H), 8.07 (s, 1H), 7.44-7.36 (m, 2H), 7.33-7.18 (m, 7H), 6.84-6.72 (m, 4H), 6.02 (d, J=3.2 Hz, 1H), 4.74 (td, J=6.2, 0.9 Hz, 2H), 4.71-4.64 (m, 2H), 4.14-4.06 (m, 1H), 3.88-3.73 (m, 8H), 3.57-3.41 (m, 4H), 3.32-3.23 (m, 3H), 3.08 (t, J=6.2 Hz, 2H), 2.77 (dt, J=13.7, 6.9 Hz, 1H), 1.14 (dd, J=6.9, 1.2 Hz, 6H).

Synthesis of Compound 216

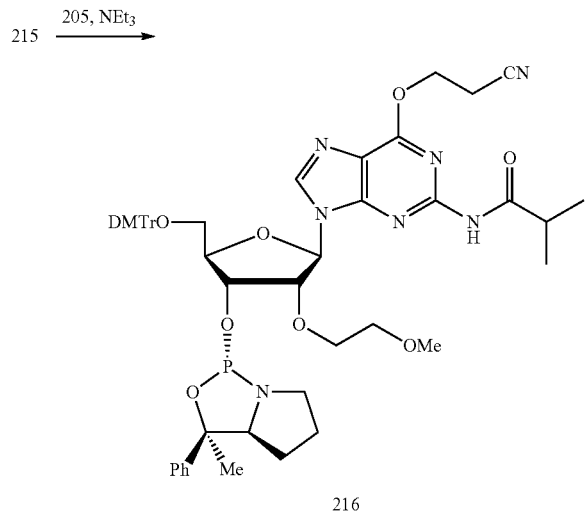

216

Compound 216:

Using a procedure analogous to that described for compound 208 and substituting compound 215 for compound 203, pure compound 216 was obtained as a colorless solid foam. $^1$H NMR (399 MHz, CD$_3$CN) δ 8.41 (s, 1H), 8.12 (s, 1H), 7.50-7.44 (m, 2H), 7.40-7.19 (m, 12H), 6.80 (dd, J=8.9, 5.2 Hz, 4H), 6.04 (d, J=5.7 Hz, 1H), 4.99 (t, J=5.5 Hz, 1H), 4.94 (ddd, J=9.9, 5.2, 3.7 Hz, 1H), 4.75 (t, J=6.2 Hz, 2H), 4.29 (q, J=3.8 Hz, 1H), 3.89-3.82 (m, 1H), 3.76-3.68 (m, 7H), 3.64 (ddd, J=6.8, 5.5, 2.3 Hz, 1H), 3.50-3.46 (m, 2H), 3.42 (s, 2H), 3.38-3.28 (m, 1H), 3.21 (s, 3H), 3.09 (t, J=6.2 Hz, 2H), 2.84 (dq, J=10.2, 7.3 Hz, 1H), 2.70-2.58 (m, 1H), 1.76 (s, 3H), 1.46-1.27 (m, 2H), 1.12 (d, J=6.8 Hz, 3H), 1.07 (d, J=6.8 Hz, 3H), 1.04-0.89 (m, 2H); $^{31}$P NMR (162 MHz, CD$_3$CN) δ 154.40.

Synthesis of Compound 217

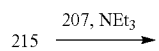

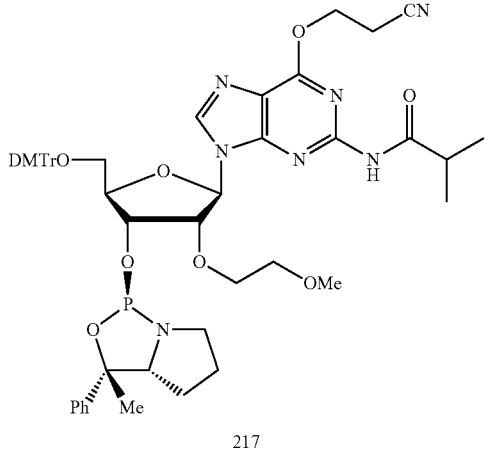

217

Compound 217:

Using a procedure analogous to that described for compound 210 and substituting compound 215 for compound 209, pure compound 217 was obtained as a colorless solid foam. $^1$H NMR (399 MHz, CD$_3$CN) δ 8.56 (s, 1H), 8.13 (s, 1H), 7.44 (dd, J=8.2, 1.5 Hz, 2H), 7.39-7.19 (m, 12H), 6.81 (dd, J=10.4, 8.9 Hz, 4H), 6.06 (d, J=4.5 Hz, 1H), 4.96-4.86 (m, 2H), 4.75 (t, J=6.2 Hz, 2H), 4.30 (td, J=5.1, 4.7, 2.4 Hz, 1H), 3.83 (dt, J=11.2, 4.3 Hz, 1H), 3.79-3.70 (m, 7H), 3.67 (ddd, J=7.1, 5.2, 2.0 Hz, 1H), 3.52-3.45 (m, 3H), 3.41 (dd, J=10.8, 2.7 Hz, 1H), 3.34-3.24 (m, 1H), 3.21 (s, 3H), 3.08 (t, J=6.1 Hz, 2H), 2.89-2.72 (m, 2H), 1.68 (s, 3H), 1.54-1.38 (m, 2H), 1.14 (dd, J=6.8, 5.4 Hz, 6H), 1.09-1.00 (m, 1H), 0.95-0.83 (m, 1H); $^{31}$P NMR (162 MHz, CD$_3$CN) δ 154.93.

Synthesis of Compound 219

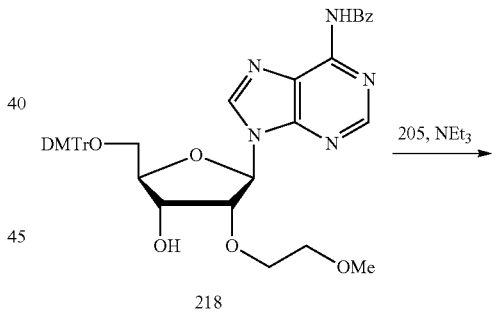

218

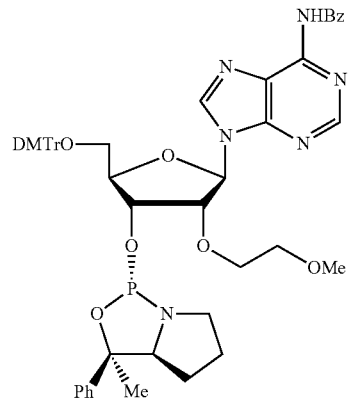

219

Compound 219:

Using a procedure analogous to that described for compound 208 and substituting compound 218 for compound 203, pure compound 219 was obtained as a colorless solid foam. ¹H NMR (399 MHz, CDCl₃) δ 9.31 (s, 1H), 8.72 (s, 1H), 8.26 (s, 1H), 8.07-7.98 (m, 2H), 7.60-7.53 (m, 1H), 7.52-7.43 (m, 4H), 7.38-7.15 (m, 12H), 6.83-6.74 (m, 4H), 6.24 (d, J=5.2 Hz, 1H), 5.03-4.92 (m, 2H), 4.45 (q, J=3.8 Hz, 1H), 3.93 (dt, J=11.4, 4.2 Hz, 1H), 3.77 (ddd, J=7.5, 5.8, 3.2 Hz, 2H), 3.73 (s, 6H), 3.60-3.49 (m, 3H), 3.47-3.37 (m, 2H), 3.26 (s, 3H), 3.02-2.92 (m, 1H), 1.81 (s, 3H), 1.56-1.43 (m, 1H), 1.37 (dq, J=13.2, 6.5 Hz, 1H), 1.22-1.09 (m, 1H), 0.96 (ddt, J=13.1, 7.9, 6.8 Hz, 1H); ³¹P NMR (162 MHz, CDCl₃) δ 157.73.

Synthesis of Compound 220

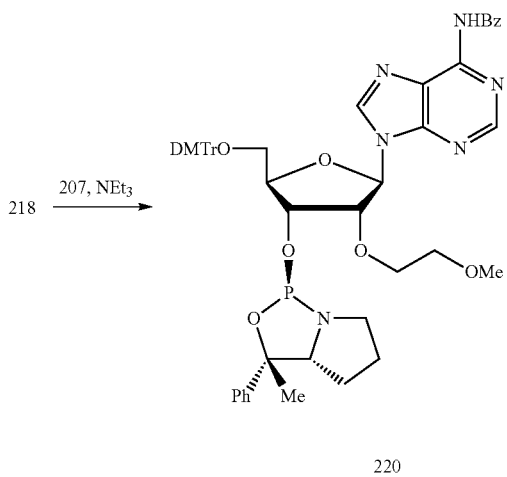

220

Compound 220:

Using a procedure analogous to that described for compound 210 and substituting compound 218 for compound 209, pure compound 220 was obtained as a colorless solid foam. ¹H NMR (399 MHz, CDCl₃) δ 9.26 (s, 1H), 8.73 (s, 1H), 8.31 (s, 1H), 8.02 (d, J=7.6 Hz, 2H), 7.60-7.53 (m, 1H), 7.52-7.40 (m, 4H), 7.39-7.13 (m, 12H), 6.84-6.76 (m, 4H), 6.24 (d, J=4.5 Hz, 1H), 4.99 (dt, J=10.0, 5.0 Hz, 1H), 4.84 (t, J=4.7 Hz, 1H), 4.46 (q, J=4.0 Hz, 1H), 3.91 (dt, J=11.1, 4.2 Hz, 1H), 3.85-3.69 (m, 8H), 3.63-3.50 (m, 3H), 3.42 (dd, J=10.7, 4.0 Hz, 1H), 3.40-3.31 (m, 1H), 3.27 (s, 3H), 3.00-2.89 (m, 1H), 1.82 (s, 3H), 1.58-1.38 (m, 2H), 1.20-1.09 (m, 1H), 1.00 (ddt, J=12.3, 8.8, 5.9 Hz, 1H); ³¹P NMR (162 MHz, CDCl₃) δ 158.98.

Synthesis of Compound 222

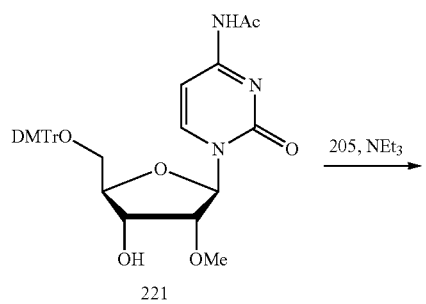

221

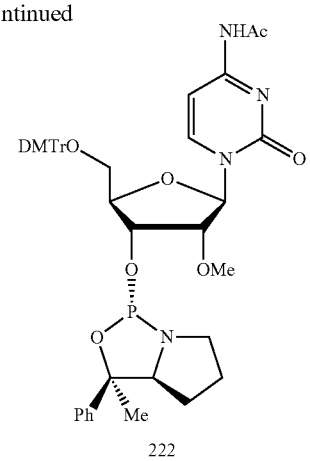

222

Compound 222:

Using a procedure analogous to that described for compound 208 and substituting compound 221 for compound 203, pure compound 222 was obtained as a colorless solid foam. ¹H NMR (499 MHz, CDCl₃) δ 10.46 (s, br, 1H), 8.62 (d, J=7.5 Hz, 1H), 7.42 (d, J=7.1 Hz, 2H), 7.36-7.21 (m, 12H), 7.00 (d, J=7.5 Hz, 1H), 6.82 (dd, J=9.0, 7.1 Hz, 4H), 6.03 (s, 1H), 4.77 (td, J=8.7, 4.8 Hz, 1H), 4.34 (dt, 0.1=9.4, 2.3 Hz, 1H), 3.97 (d, J=4.8 Hz, 1H), 3.78 (dd, J=6.7, 3.4 Hz, 1H), 3.74 (s, 3H), 3.71 (s, 6H), 3.68-3.58 (m, 2H), 3.48-3.38 (m, 1H), 3.01 (p, J=7.8 Hz, 1H), 2.27 (s, 3H), 1.72 (s, 3H), 1.49 (tt, J=12.3, 7.0 Hz, 1H), 1.40 (dq, J=13.2, 6.6 Hz, 1H), 1.18 (dq, J=13.9, 7.0 Hz, 1H), 1.02-0.90 (m, 1H); ³¹P NMR (202 MHz, CDCl₃) δ 158.71.

Synthesis of Compound 223

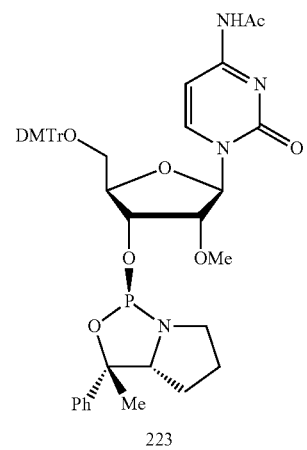

223

Compound 223:

Using a procedure analogous to that described for compound 210 and substituting compound 221 for compound 209, pure compound 223 was obtained as a colorless solid foam. ¹H NMR (500 MHz, CDCl₃) δ 9.76 (s, 1H), 8.70 (d, J=7.4 Hz, 1H), 7.48-7.41 (m, 2H), 7.41-7.18 (m, 12H), 7.06 (d, J=7.4 Hz, 1H), 6.87 (dd, J=8.9, 1.9 Hz, 4H), 6.00 (s, 1H), 4.80 (td, J=9.2, 4.7 Hz, 1H), 4.33 (d, J=9.5 Hz, 1H), 3.84 (d, J=4.7 Hz, 1H), 3.81 (s, 3H), 3.80 (s, 3H), 3.72 (d, J=6.6, 3.4 Hz, 1H), 3.70-3.62 (m, 4H), 3.53 (dd, J=11.3, 2.2 Hz, 1H), 3.34 (tdd, J=10.7, 7.8, 4.9 Hz, 1H), 2.96 (dq, J=10.3, 7.6 Hz, 1H), 2.25 (s, 3H), 1.83 (s, 3H), 1.56-1.48 (m, 1H), 1.43 (dq, J=13.1, 6.4 Hz, 1H), 1.24-1.16 (m, 1H), 1.00-0.91 (m, 1H). ³¹P NMR (202 MHz, CDCl₃) δ 157.17.

Synthesis of Compound 225

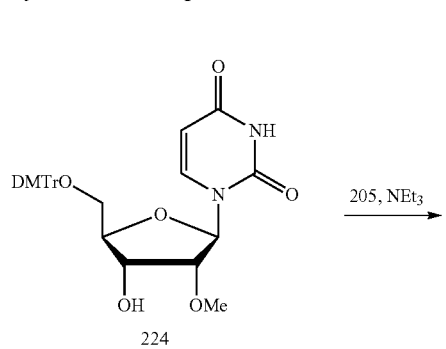

Synthesis of Compound 226

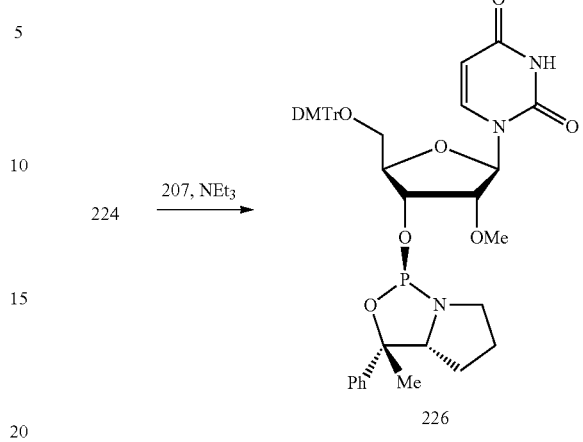

Compound 226:

Using a procedure analogous to that described for compound 210 and substituting compound 224 for compound 209, pure compound 226 was obtained as a colorless solid foam. ¹H NMR (499 MHz, CDCl₃) δ 9.8-9.0 (br, 1H), 8.09 (d, J=8.2 Hz, 1H), 7.40 (d, J=7.4 Hz, 2H), 7.36-7.19 (m, 12H), 6.80 (dd, J=11.4, 8.8 Hz, 4H), 6.02 (d, J=2.2 Hz, 1H), 5.22 (d, J=8.1 Hz, 1H), 4.82 (td, J=8.1, 4.9 Hz, 1H), 4.27 (d, J=7.4 Hz, 1H), 3.96 (dd, J=5.0, 2.2 Hz, 1H), 3.81-3.76 (m, 1H), 3.74 (s, 3H), 3.70 (s, 3H), 3.62 (s, 3H), 3.61-3.54 (m, 2H), 3.50-3.41 (m, 1H), 3.04 (dtd, J=10.2, 8.0, 6.3 Hz, 1H), 1.75 (s, 3H), 1.56-1.47 (m, 1H), 1.44-1.35 (m, 1H), 1.26-1.18 (m, 1H), 0.95 (dq, J=12.3, 7.5 Hz, 1H); ³¹P NMR (202 MHz, CDCl₃) δ 158.96.

Synthesis of Compound 228

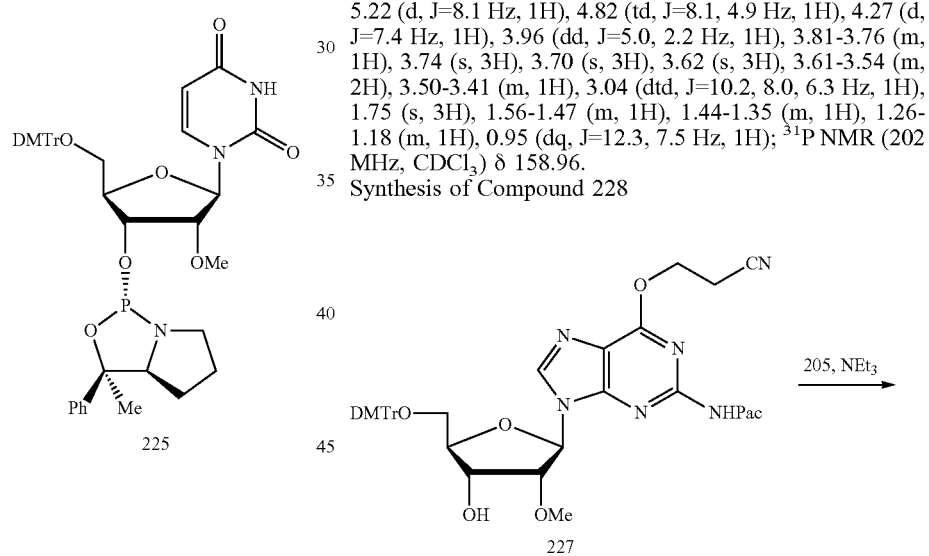

Compound 225:

Using a procedure analogous to that described for compound 208 and substituting compound 224 for compound 203, pure compound 225 was obtained as a colorless solid foam. ¹H NMR (500 MHz, CDCl₃) δ 9.76 (s, br, 1H), 8.70 (d, J=7.4 Hz, 1H), 7.48-7.41 (m, 2H), 7.41-7.18 (m, 12H), 7.06 (d, J=7.4 Hz, 1H), 6.87 (dd, J=8.9, 1.9 Hz, 4H), 6.00 (s, 1H), 4.80 (td, J=9.2, 4.7 Hz, 1H), 4.33 (d, J=9.5 Hz, 1H), 3.84 (d, J=4.7 Hz, 1H), 3.81 (s, 3H), 3.80 (s, 3H), 3.72 (td, J=6.6, 3.4 Hz, 1H), 3.69-3.62 (m, 4H), 3.53 (dd, J=11.3, 2.2 Hz, 1H), 3.34 (tdd, J=10.7, 7.8, 4.9 Hz, 1H), 2.96 (dq, J=10.3, 7.6 Hz, 1H), 2.25 (s, 3H), 1.83 (s, 3H), 1.56-1.48 (m, 1H), 1.43 (dq, J=13.1, 6.4 Hz, 1H), 1.24-1.16 (m, 1H), 1.00-0.91 (m, 1H); ³¹P NMR (202 MHz, CDCl₃) δ 158.97.

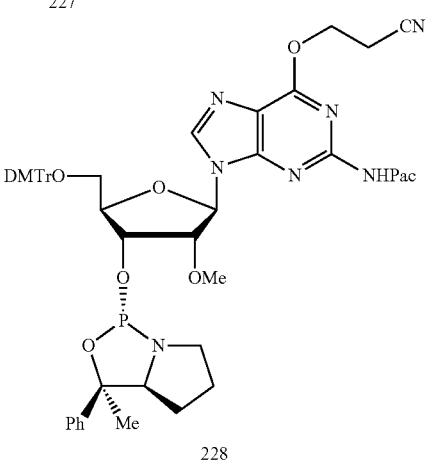

Compound 228:

Using a procedure analogous to that described for compound 208 and substituting compound 227 for compound 203, pure compound 228 was obtained as a colorless solid foam. $^{31}$P NMR (202 MHz, CDCl$_3$) δ 158.16.

Synthesis of Compound 229

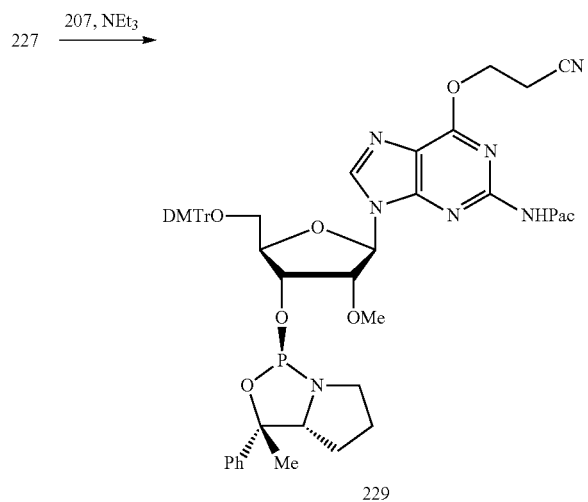

229

Compound 229:

Using a procedure analogous to that described for compound 210 and substituting compound 227 for compound 209, pure compound 229 was obtained as a colorless solid foam. $^{31}$P NMR (202 MHz, CDCl$_3$) δ 158.84.

Synthesis of Compound 231

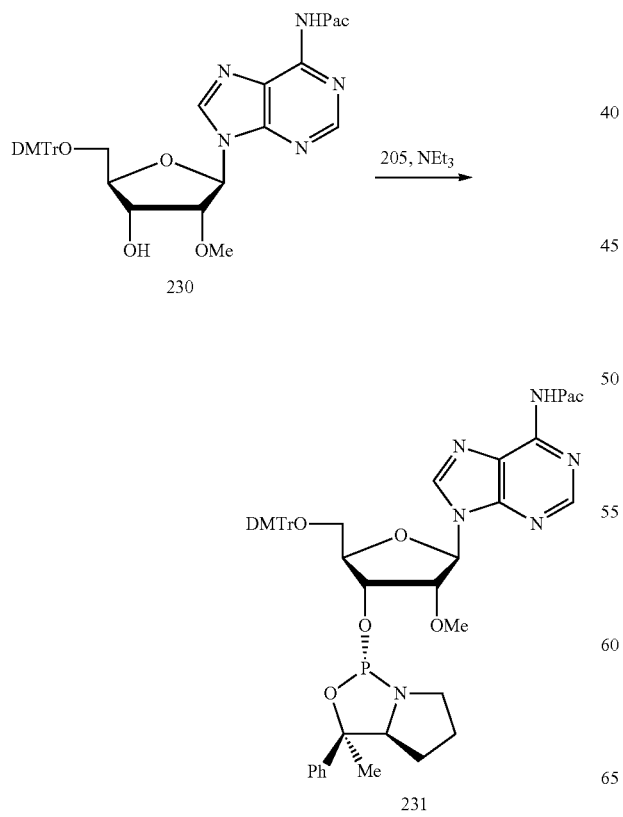

230

231

Compound 231:

Using a procedure analogous to that described for compound 208 and substituting compound 230 for compound 203, pure compound 231 was obtained as a colorless solid foam. $^1$H NMR (499 MHz, CDCl$_3$) δ 9.6-9.3 (s, 1H), 8.73 (s, 1H), 8.32 (s, 1H), 7.50-7.41 (m, 2H), 7.39-7.16 (m, 14H), 7.10-7.01 (m, 3H), 6.82 (d, J=8.8 Hz, 4H), 6.21 (d, J=4.1 Hz, 1H), 4.96 (dt, J=10.1, 5.1 Hz, 1H), 4.86 (s, 2H), 4.54 (t, J=4.5 Hz, 1H), 4.43 (q, J=3.9 Hz, 1H), 3.81-3.75 (m, 7H), 3.62 (dd, J=10.8, 3.3 Hz, 1H), 3.54 (s, 3H), 3.46-3.42 (m, 1H), 3.41-3.33 (m, 1H), 3.01-2.93 (m, 1H), 1.82 (s, 3H), 1.56-1.47 (m, 1H), 1.44 (dq, J=13.2, 6.5 Hz, 1H), 1.22-1.11 (m, 1H), 1.03-0.94 (m, 1H); $^{31}$P NMR (202 MHz, CDCl$_3$) δ 158.11.

Synthesis of Compound 232

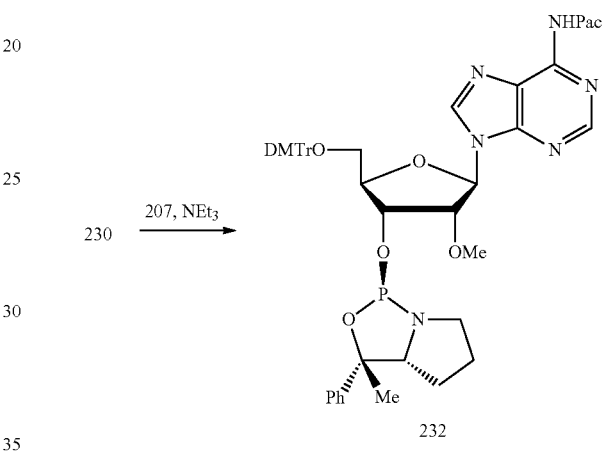

232

Compound 232:

Using a procedure analogous to that described for compound 210 and substituting compound 230 for compound 209, pure compound 232 was obtained as a colorless solid foam. $^1$H NMR (499 MHz, CDCl$_3$) δ 9.8-9.2 (br, 1H), 8.71 (s, 1H), 8.23 (s, 1H), 7.49-7.43 (m, 2H), 7.40-7.15 (m, 14H), 7.09-7.02 (m, 3H), 6.79 (d, J=8.9 Hz, 4H), 6.20 (d, J=5.6 Hz, 1H), 4.93 (ddd, J=9.3, 5.0, 3.8 Hz, 1H), 4.86 (s, 2H), 4.73 (t, J=5.3 Hz, 1H), 4.43 (q, J=3.9 Hz, 1H), 3.79-3.75 (m, 1H), 3.74 (s, 3H), 3.74 (s, 3H), 3.57 (dt, J=6.8, 3.8 Hz, 1H), 3.52 (s, 3H), 3.46-3.36 (m, 2H), 2.99 (dtd, J=10.1, 7.9, 6.5 Hz, 1H), 1.80 (s, 3H), 1.54-1.45 (m, 1H), 1.39-1.31 (m, 1H), 1.23-1.13 (m, 1H), 0.99-0.90 (m, 1H); $^{31}$P NMR (202 MHz, CDCl$_3$) δ 158.13.

Synthesis of Compound 234

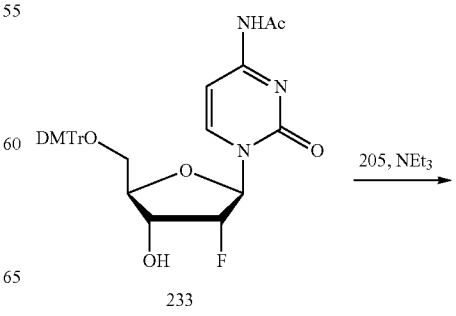

233

-continued

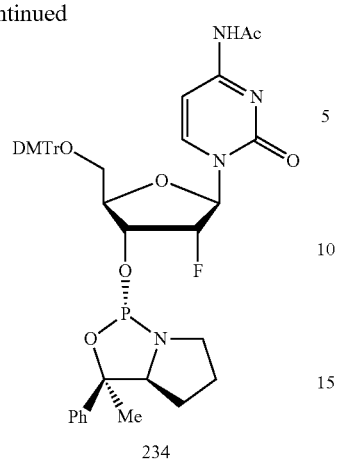

234

Compound 234:

Using a procedure analogous to that described for compound 208 and substituting compound 233 for compound 203, pure compound 234 was obtained as a colorless solid foam.

Synthesis of Compound 235

-continued

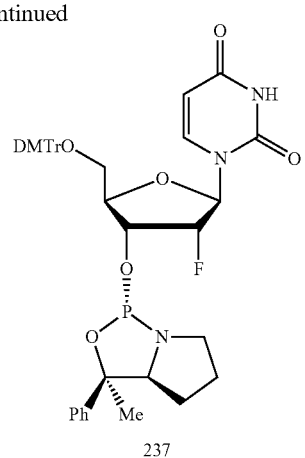

237

Compound 237:

Using a procedure analogous to that described for compound 208 and substituting compound 236 for compound 203, pure compound 237 was obtained as a colorless solid foam. $^{31}$P NMR (202 MHz, Chloroform-d) δ 159.51 (d, $J_{P-F}$=9.5 Hz).

Synthesis of Compound 238

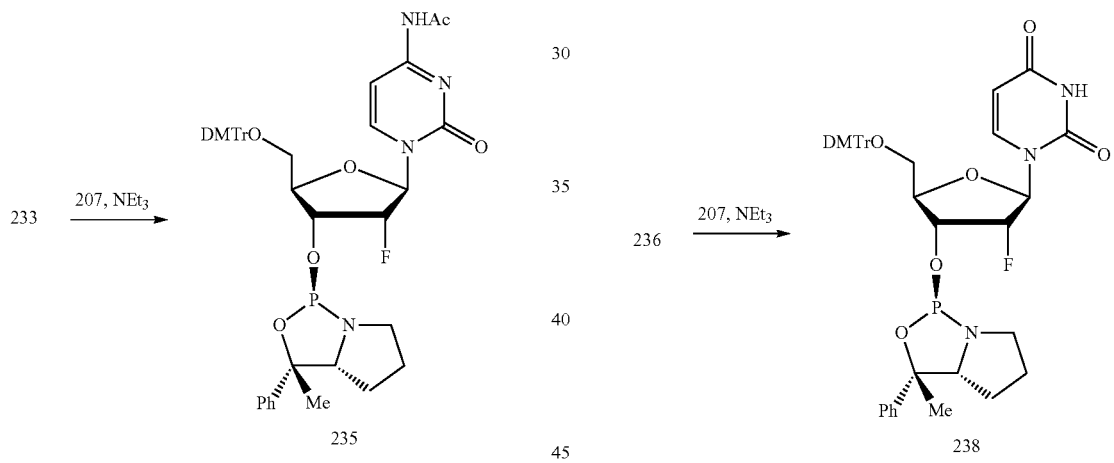

Compound 235:

Using a procedure analogous to that described for compound 210 and substituting compound 233 for compound 209, pure compound 235 was obtained as a colorless solid foam. $^{31}$P NMR (202 MHz, CDCl$_3$) δ 158.75.

Synthesis of Compound 237

Compound 238:

Using a procedure analogous to that described for compound 210 and substituting compound 236 for compound 209, pure compound 238 was obtained as a colorless solid foam. $^{31}$P NMR (202 MHz, Chloroform-d) δ 159.48.

Synthesis of Compound 240

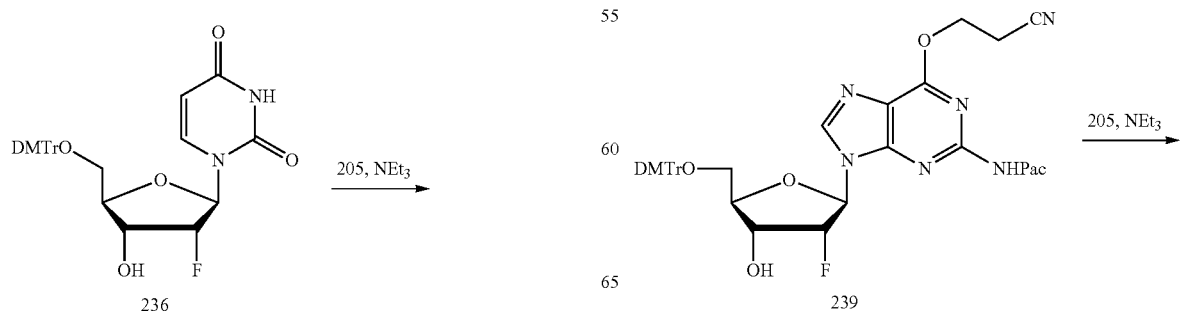

Synthesis of Compound 243

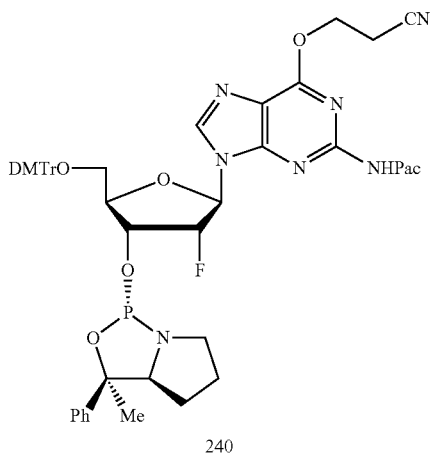

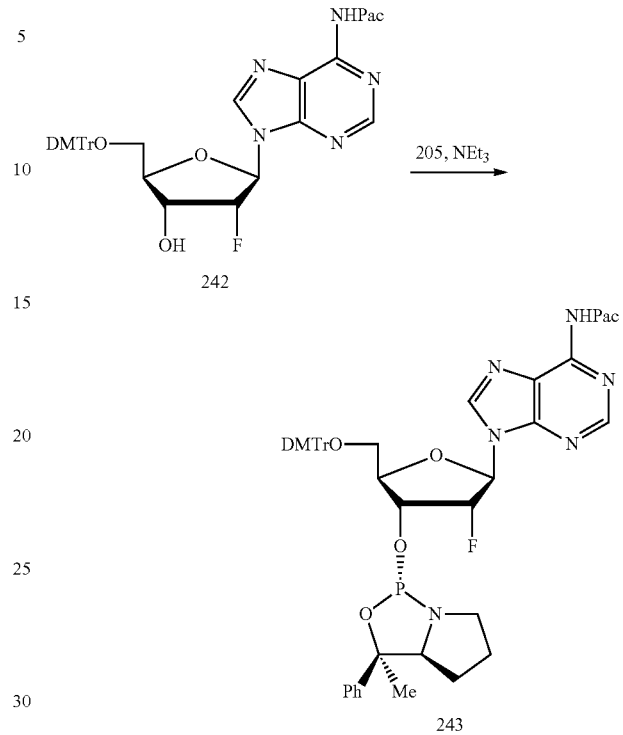

Compound 240:

Using a procedure analogous to that described for compound 208 and substituting compound 239 for compound 203, pure compound 240 was obtained as a colorless solid foam. $^{31}$P NMR (202 MHz, CDCl$_3$) δ 160.20 (d, $J_{P\text{-}F}$=11.0 Hz).

Synthesis of Compound 241

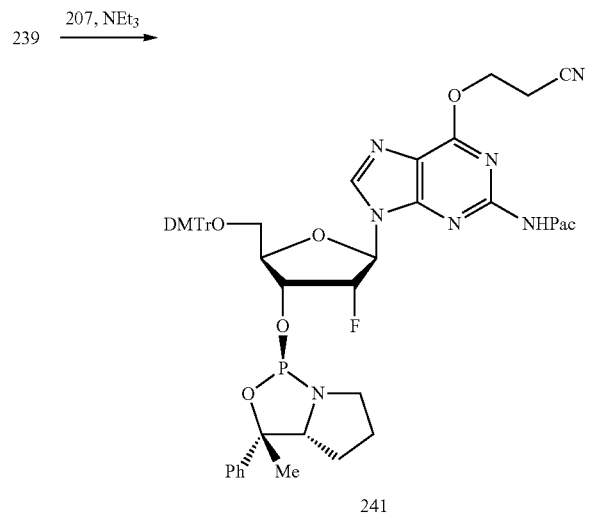

Compound 241:

Using a procedure analogous to that described for compound 210 and substituting compound 239 for compound 209, pure compound 241 was obtained as a colorless solid foam. $^{31}$P NMR (202 MHz, CDCl$_3$) δ 159.66 (d, $J_{P\text{-}F}$=8.4 Hz).

Compound 243:

Using a procedure analogous to that described for compound 208 and substituting compound 242 for compound 203, pure compound 243 was obtained as a colorless solid foam. $^{31}$P NMR (202 MHz, CDCl$_3$) δ 160.20 (d, J=11.0 Hz).

Synthesis of Compound 244

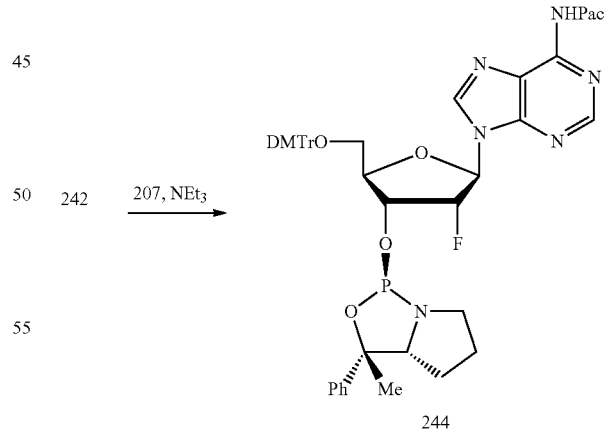

Compound 244:

Using a procedure analogous to that described for compound 210 and substituting compound 242 for compound 209, pure compound 244 was obtained as a colorless solid foam. $^{31}$P NMR (202 MHz, CDCl$_3$) δ 156.52 (d, $J_{P\text{-}F}$=8.5 Hz).

Synthesis of Compound 246

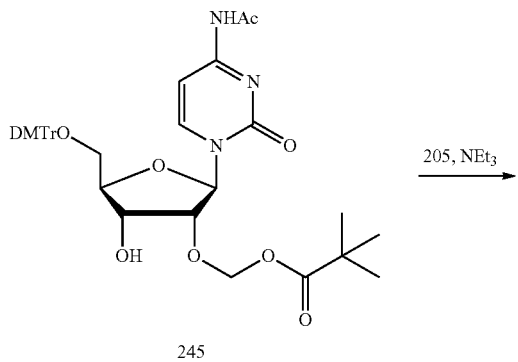

245

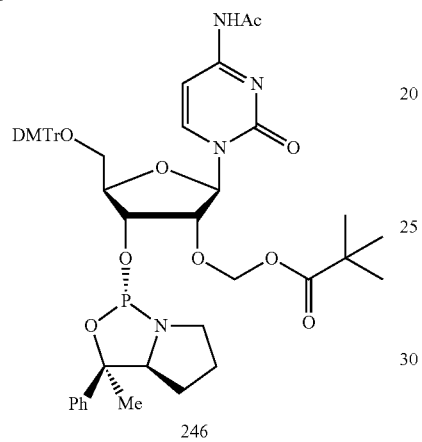

246

Compound 246:

Using a procedure analogous to that described for compound 208 and substituting compound 245 for compound 203, pure compound 246 is obtained as a colorless solid foam.

Synthesis of Compound 247

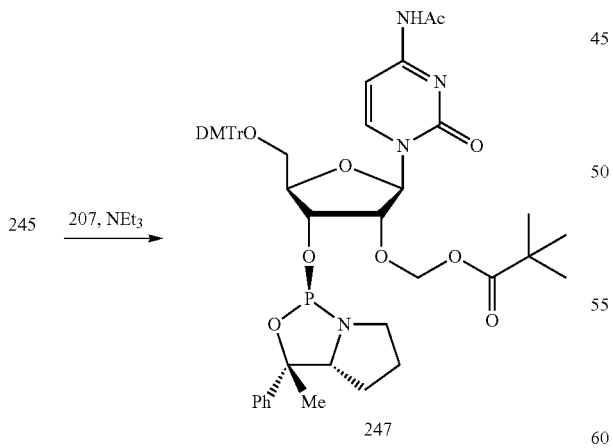

247

Compound 247:

Using a procedure analogous to that described for compound 210 and substituting compound 245 for compound 209, pure compound 247 is obtained as a colorless solid foam.

Synthesis of Compound 249

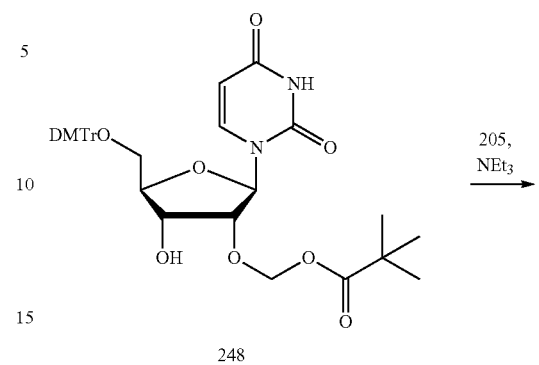

248

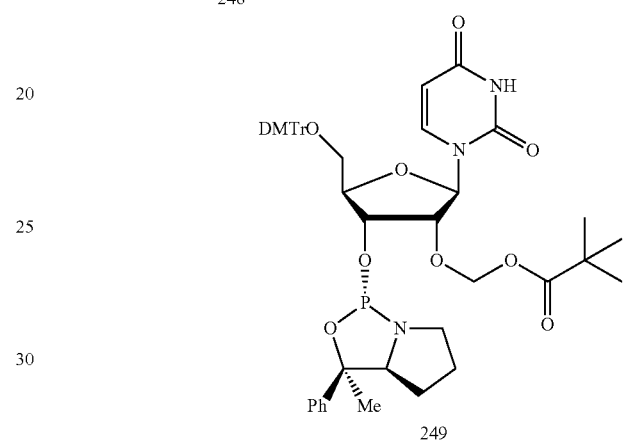

249

Compound 249:

Using a procedure analogous to that described for compound 208 and substituting compound 248 for compound 203, pure compound 249 is obtained as a colorless solid foam.

Synthesis of Compound 250

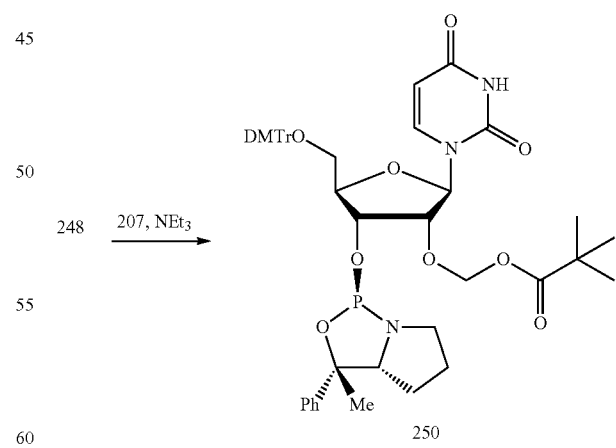

250

Compound 250:

Using a procedure analogous to that described for compound 210 and substituting compound 248 for compound 209, pure compound 250 is obtained as a colorless solid foam.

Synthesis of Compound 252

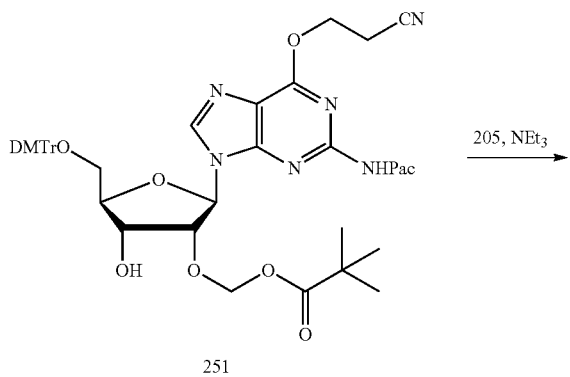

251

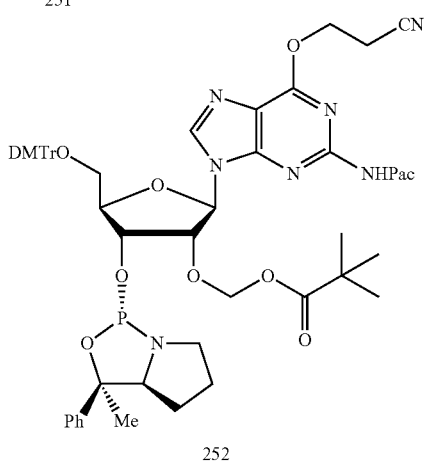

252

Compound 252:
Using a procedure analogous to that described for compound 208 and substituting compound 251 for compound 203, pure compound 252 is obtained as a colorless solid foam.

Synthesis of Compound 253

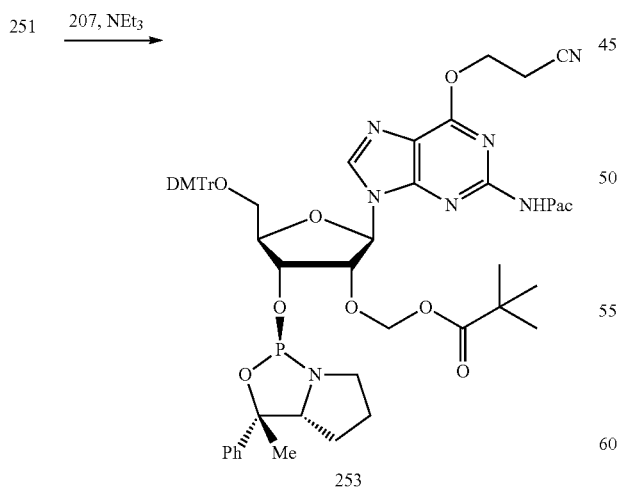

253

Compound 253: Using a procedure analogous to that described for compound 210 and substituting compound 251 for compound 209, pure compound 253 is obtained as a colorless solid foam.

Synthesis of Compound 255

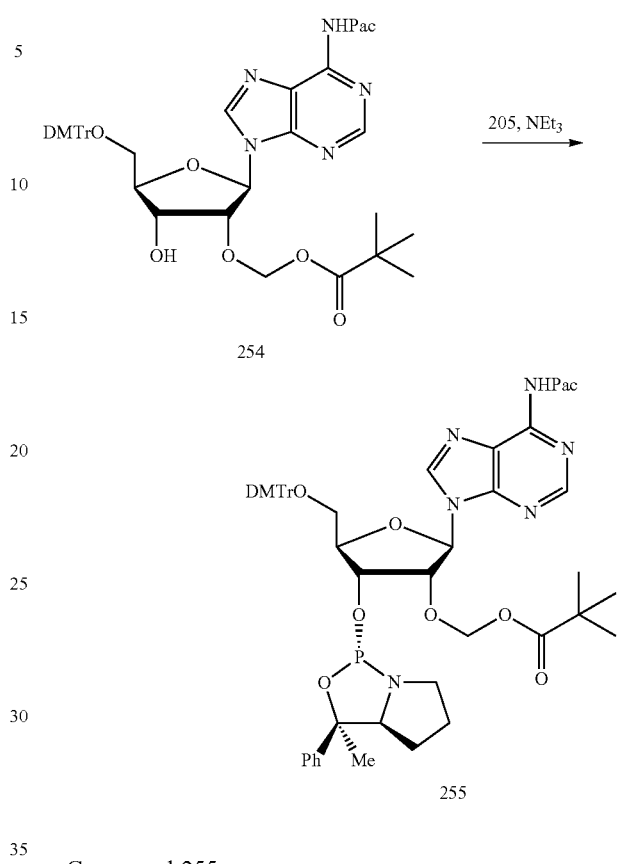

Compound 255:
Using a procedure analogous to that described for compound 208 and substituting compound 254 for compound 203, pure compound 255 is obtained as a colorless solid foam.

Synthesis of Compound 256

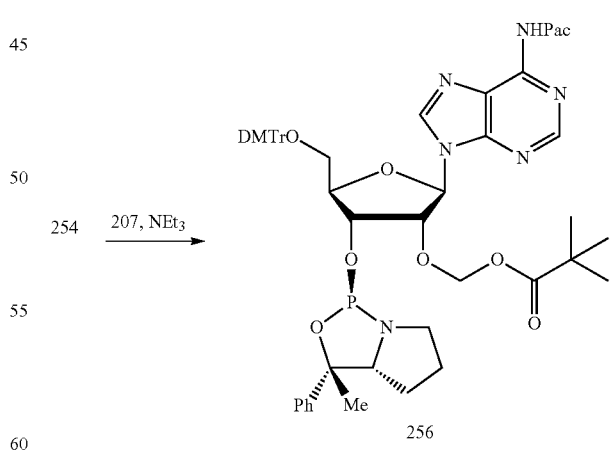

Compound 256:
Using a procedure analogous to that described for compound 210 and substituting compound 254 for compound 209, pure compound 256 is obtained as a colorless solid foam.

Synthesis of Compound 258

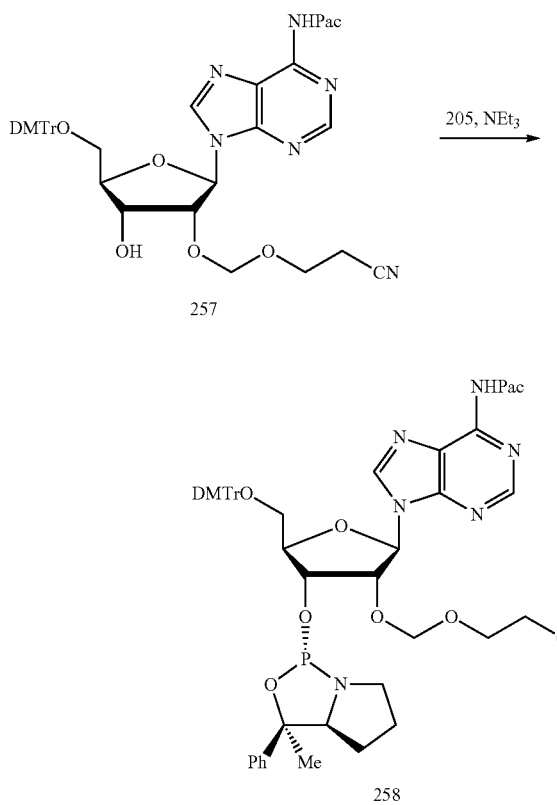

Compound 258:
Using a procedure analogous to that described for compound 208 and substituting compound 257 for compound 203, pure compound 258 is obtained as a colorless solid foam.

Synthesis of Compound 259

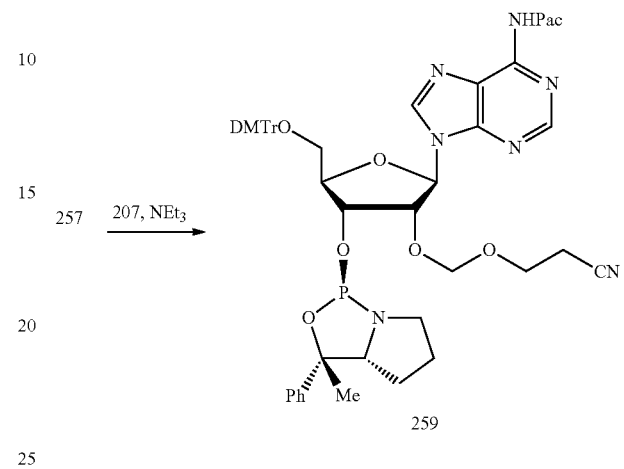

Compound 259:
Using a procedure analogous to that described for compound 210 and substituting compound 257 for compound 209, pure compound 259 is obtained as a colorless solid foam.

Examples 2-16

Summarized below in Table E-1 is the synthetic procedure for Examples 2-16 on the DNA/RNA Synthesizer ABI-394.

TABLE E-1

Summary for Oligonucleotide Synthesis on a DNA/RNA Synthesizer ABI-394 Used for the Synthesis of Examples 2-16.

| step | reaction | reagent | delivery time (sec) 1 μmol | delivery time (sec) 10 μmol | wait time (sec) 1 μmol | wait time (sec) 10 μmol |
|---|---|---|---|---|---|---|
| 1 | detritylation | 3% TCA in DCM | 3 + 60 + 10 | 3 + 90 + 10 | N.A. | N.A. |
| 2 | coupling | 0.15 M phosphoramidite in ACN + 1.2 M CMPT in ACN | 5 + 4 | 10 + 6 | 30 + 600 | 30 + 600 |
| 3 | capping 1 | 5% Pac$_2$O in THF/2,6-lutidine | 20 | 30 | 60 | 60 |
| 4 | capping 2 | 5% Pac$_2$O in THF/2,6-lutidine + 16% NMI in THF | 20 | 30 | 60 | 60 |
| 5 | sulfurization | 0.3 M S-cyanoethyl-Methyl\|Thio-Sulfonate | 10 + 4 × 2 | 15 + 4 × 4 | 300 + 3 × 150 + 600 | 300 + 3 × 150 + 600 | in ACN/BSTFA

Examples 2-9

The oligonucleotides containing stereodefined phosphorothioate diester internucleotidic linkages were synthesized on an ABI-394 DNA/RNA synthesizer according to the cycle summarized in Table E-1 using a 10 μmol synthesis column and 6.5 μmol of succinyl linked dC on CPG. The synthesis cycle was performed with removal of the terminal 5'-O-DMTr group (DMT Off). The solid support was washed with dry ACN and dried under a flux of argon. The dry solid support was then treated with 5 mL of anhydrous 1 M solution of 1,8-diazabicycloundec-7-ene (DBU) in dry ACN-trimethylsilyl chloride—16:1 (v/v) for 10 min at r.t., during which time the solution was slowly pushed through the column by means of a plastic luer syringe fixed to the outlet of the column. The support was then washed with dry ACN and dried under vacuum. The dry CPG was placed in a plastic vial and then treated with 3 mL of 28% aqueous ammonia for a period of 18 h at r.t. The solvents were evaporated to dryness, the residue was re-suspended in 10% aqueous DMSO, and the solid support was filtered off. The crude product was purified by anion exchange preparative HPLC (Gradient of 0.25 to 1.75 M NaCl in 20 mM NaOH). The fractions having purity above 95% were pooled, concentrated and desalted by reverse-phase HPLC (Gradient of 0 to 80% ACN). The final desalted product was lyophilized from water.

Examples 10-16

The oligonucleotides containing stereodefined phosphorothioate diester internucleotidic linkages were synthesized on an ABI-394 DNA/RNA synthesizer according to the cycle summarized in Table E-1 using 1 μmol synthesis column and 3 μmol of succinyl linked dC on CPG. The synthesis cycle was performed with removal of the terminal 5'-O-DMTr group (DMT Off). The solid support was washed with dry ACN and dried under a flux of argon. The dry solid support was then treated with 5 mL of anhydrous 1 M solution of 1,5-diazabicyclo(4.3.0) non-5-ene (DBN) in dry ACN-trimethylsilyl chloride—16:1 (v/v) for 10 min at r.t. The DBN solution was slowly pushed through the column by means of a plastic luer syringe fixed to the outlet of the column. The support was then washed with dry ACN and dried under vacuum. The dry CPG was placed in a plastic vial and was treated with 2 mL of 28% aqueous ammonia for a period of 18 h at r.t. The solvents were evaporated to dryness, the residue was re-suspended in 10% aqueous DMSO, and the solid support was filtered off.

Purification and Desalting of Examples 2-16:

The crude product was purified by Waters 2525 BGM HPLC system, equipped with a 2487 dual wavelength detector and with FCO and Flex inject. An AP-1 glass column from Waters, 10×200 mm was filled with Source 15Q Support (GE Healthcare, Part no. 17-0947-01) and was used with flow rate of 4 mL/min. Column was heated during all the purifications using a TL600 mobile phase heater and TL150 Temperature controller (Timberline Instruments) set at 75° C. Buffer A: 20 mM NaOH and Buffer B: 20 mM NaOH, 2.5 M NaCl were used with step gradients starting from 30% B to 70% B. The fractions having purity above 95% were pooled, concentrated and desalted on the same HPLC system by reverse-phase column (XBridge Semi Prep, 250×10 mm, $C_{18}$, 5 μm) with a gradient of water to 80% ACN and 4 mL/min flow rate. The final desalted product was concentrated in speedvac followed by lyophilization from water.

HPLC analysis of purified oligonucleotides: Quality of oligonucleotides was determined using DNA Pac 100 (10× 250 mm) and using the following conditions:
Buffer A: 10 mM Tris HCl, 50% HCl, pH=8.0
Buffer B: A+0.8 M $NaClO_4$, pH=8.0
Column temperature: 60° C.
Gradient Method:

| | Time | Flow | % A | % B | Curve |
|---|---|---|---|---|---|
| 1 | 0.01 | 1.00 | 85.0 | 15.0 | |
| 2 | 3.00 | 1.00 | 85.0 | 15.0 | 1 |
| 3 | 23.00 | 1.00 | 40.0 | 60.0 | 6 |
| 4 | 25.00 | 1.00 | 5.0 | 95.0 | 6 |
| 5 | 25.50 | 1.00 | 85.0 | 15.0 | 6 |
| 6 | 30.00 | 1.00 | 85.0 | 15.0 | 1 |

LCMS Analysis Method:
Eluent A: 15 mM TEA, 400 mM HFIP, Water
Eluent B: 50:50 Buffer A/Methanol
Column: UPLC@OST $C_{18}$ 1.7 μm, 2.1×500 mm
Column temperature=50° C.
Gradient method:

| Time | Flow | % A | % B | Curve |
|---|---|---|---|---|
| 0 | 0.2 | 95 | 5 | |
| 10 | 0.2 | 35 | 65 | 6 |
| 12 | 0.2 | 5 | 95 | 6 |
| 12.5 | 0.2 | 95 | 5 | 6 |
| 15 | 0.2 | 95 | 5 | 1 |

Example 2. Synthesis of Oligonucleotide 101 (All-(Rp)-d[GsCsCsTsCsAsGsTsCsTsGsCsTsTsCsGsC-sAsCsC] (SEQ ID NO: 106)

Oligonucleotide 101 was synthesized as described above. RT in IEX-HPLC: 14.70 min. UPLC/ESI-MS: Calcd for $C_{191}H_{246}N_{67}O_{102}P_{19}S_{19}$: 6310.2; Found: 6310.4.

Example 3. Synthesis of Oligonucleotide 102 (All-(Sp)-d[GsCsCsTsCsAsGsTsCsTsGsCsTsTsCsGsC-sAsCsC] (SEQ ID NO: 106)

Oligonucleotide 102 was synthesized as described above. RT in IEX-HPLC: 15.49 min. UPLC/ESI-MS: Calcd for $C_{191}H_{246}N_{67}O_{102}P_{19}S_{19}$: 6310.2; Found: 6310.2.

Example 4. Synthesis of Oligonucleotide 103 ((Rp, Rp, Rp, Rp, Rp, Sp, Sp, Sp, Sp, Sp, Sp, Sp, Sp, Sp, Rp, Rp, Rp, Rp, Rp)-d[GsCsCsTsCsAsGsT-sCsTsGsCsTsTsCsGsCsAsCsC] (SEQ 1 D NO: 106) (5R-9S-5R))

Oligonucleotide 103 was synthesized as described above. RT in IEX-HPLC: 15.10 min. UPLC/ESI-MS: Calcd for $C_{191}H_{246}N_{67}O_{102}P_{19}S_{19}$: 6310.2; Found: 6310.3.

Example 5. Synthesis of Oligonucleotide 104 ((Sp, Sp, S, Sp, Sp, Rp, Rp, Rp, Rp, Rp, Rp, Rp, Rp, Rp, Sp, Sp, Sp, Sp, Sp)-d[GsCsCsTsCsAsGsTsCsT-sGsCsTsTsCsGsCsAsCsC] (SEQ ID NO: 106) (5S-9R-5S))

Oligonucleotide 104 was synthesized as described above. RT in IEX-HPLC: 15.04 min. UPLC/ESI-MS: Calcd for $C_{191}H_{246}N_{67}O_{102}P_{19}S_{19}$: 6310.2; Found: 6307.2.

Example 6. Synthesis of Oligonucleotide 105 ((Sp, Rp, Rp, Rp, Rp, Rp, Rp, Rp, Rp, Rp, Rp, Rp, Rp, Rp, Rp, Rp, Rp, Rp, Sp)-d[GsCsCsTsCsAsGsT-sCsTsGsCsTsTsCsGsCsAsCsC] (SEQ ID NO: 106) (1S-17R-1S))

Oligonucleotide 105 was synthesized as described above. RT in IEX-HPLC: 14.75 min. UPLC/ESI-MS: Calcd for $C_{191}H_{246}N_{67}O_{102}P_{19}S_{19}$: 6310.2; Found: 6310.2.

Example 7. Synthesis of Oligonucleotide 106 ((Rp, Sp, Sp, Sp, Sp, Sp, Sp, Sp, Sp, Sp, Sp, Sp, Sp, Sp, Sp, Sp, Sp, Sp, Rp)-d[GsCsCsTsCsAsGsTsCsT-sGsCsTsTsCsGsCsAsCsC] (SEQ ID NO: 106) (1R-17S-1R))

Oligonucleotide 106 was synthesized as described above. RT in IEX-HPLC: 15.43 min. UPLC/ESI-MS: Calcd for $C_{191}H_{246}N_{67}O_{102}P_{19}S_{19}$: 6310.2; Found: 6309.6.

Example 8. Synthesis of Oligonucleotide 107 ((Rp, Sp, Rp, Sp, Rp, Sp, Rp, Sp, Rp, Sp, Rp, Sp, Rp, Sp, Rp, Sp, Rp, Sp, Rp)-d[GsCsCsTsCsAsGsT-sCsTsGsCsTsTsCsGsCsAsCsC] (SEQ ID NO: 106) ((R/S)$_9$R))

Oligonucleotide 107 was synthesized as described above. RT in IEX-HPLC: 15.02 min. UPLC/ESI-MS: Calcd for $C_{191}H_{246}N_{67}O_{102}P_{19}S_{19}$: 6310.2; Found: 6310.7.

Example 9. Synthesis of Oligonucleotide 108 ((Sp, Rp, Sp, Rp, Sp, Rp, Sp, Rp, Sp, Rp, Sp, Rp, Sp, Rp, Sp, Rp, Sp, Rp, Sp)-d[GsCsCsTsCsAsGsT-sCsTsGsCsTsTsCsGsCsAsCsC] (SEQ ID NO: 106) ((S/R)$_9$S))

Oligonucleotide 108 was synthesized as described above. RT in IEX-HPLC: 15.10 min. UPLC/ESI-MS: Calcd for $C_{191}H_{246}N_{67}O_{102}P_{19}S_{19}$: 6310.2; Found: 6307.9.

Example 10. Synthesis of Oligonucleotide 109 ((Sp, Sp, Sp, Rp, Rp, Rp, Rp, Rp, Rp, Rp, Rp, Rp, Rp, Rp, Rp, Rp, Sp, Sp, Sp)d[GsCsCsTsCsAsGsT-sCsTsGsCsTsTsCsGsCsAsCsC] (SEQ 11) NO: 106) (3S-13R-3S))

Oligonucleotide 109 was synthesized as described above. RT in IEX-HPLC: 14.91 min. UPLC/ESI-MS: Calcd for $C_{191}H_{246}N_{67}O_{102}P_{19}S_{19}$: 6310.2; Found: 6309.5.

Example 11. Synthesis of Oligonucleotide 110 ((Rp, Rp, Rp, Sp, Sp, Sp, Sp, Sp, Sp, Sp, Sp, Sp, Sp, Sp, Sp, Sp, Rp, Rp, Rp)-d[GsCsCsTsCsAsGsT-sCsTsGsCsTsTsCsGsCsAsCsC] (SEQ IC) NO: 106) (3R-13S-3R))

Oligonucleotide 110 was synthesized as described above. RT in IEX-HPLC: 15.24 min. UPLC/ESI-MS: Calcd for $C_{191}H_{246}N_{67}O_{102}P_{19}S_{19}$: 6310.2; Found: 6309.3.

Example 12. Synthesis of Oligonucleotide 111 ((Sp, Sp, Sp, Sp, Sp, Sp, Sp, Sp, Sp, Sp, Sp, Sp, Sp, Sp, Sp, Sp, Sp, Sp, Rp)-d[GsCsCsTsCsAsGsTsCsT-sGsCsTsTsCsGsCsAsCsC] (SEQ ID NO: 106) ((18S/R$^{19}$))

Oligonucleotide 111 was synthesized as described above. RT in IEX-HPLC: 15.69 min. UPLC/ESI-MS: Calcd for $C_{191}H_{246}N_{67}O_{102}P_{19}S_{19}$: 6310.2; Found: 6309.4.

Example 13. Synthesis of Oligonucleotide 113 ((Sp, Rp, Sp, Sp, S, Sp, Sp, Sp, Sp, Sp, Sp, Sp, Sp, Sp, Sp, Sp, Sp, Sp, Sp)-d[GsCsCsTsCsAsGsTsCsT-sGsCsTsTsCsGsCsAsCsC] (SEQ ID NO: 106) (18S/R$^2$))

Oligonucleotide 113 was synthesized as described above. RT in IEX-HPLC: 15.72 min. UPLC/ESI-MS: Calcd for $C_{191}H_{246}N_{67}O_{102}P_{19}S_{19}$: 6310.2; Found: 6311.0.

Example 14. Synthesis of Oligonucleotide 114 ((Rp, Rp, Sp, Rp, Rp, Sp, Rp, Rp, Sp, Rp, Rp, Sp, Rp, Rp, Sp, Rp, Rp, Sp, Rp)-d[GsCsCsTsCsAsGsT-sCsTsGsCsTsTsCsGsCsAsCsC] (SEQ ID NO: 106) ((RRS)$_6$—R))

Oligonucleotide 114 was synthesized as described above. RT in IEX-HPLC: 14.14 min. UPLC/ESI-MS: Calcd for $C_{191}H_{246}N_{67}O_{102}P_{19}S_{19}$: 6310.2; Found: 6313.7.

Example 15. Synthesis of Oligonucleotide 115 ((Sp, Rp, Rp, Sp, Rp, Rp, Sp, Rp, Rp, Sp, Rp, Rp, Sp, Rp, Rp, Sp, Rp, Rp, Sp)-d[GsCsCsTsCsAsGsT-sCsTsGsCsTsTsCsGsCsAsCsC] (SEQ ID NO: 106) (S—(RRS)$_6$))

Oligonucleotide 115 was synthesized as described above. RT in IEX-HPLC: 14.30 min. UPLC/ESI-MS: Calcd for $C_{191}H_{246}N_{67}O_{102}P_{19}S_{19}$: 6310.2; Found: 6313.7.

Example 16. Synthesis of Oligonucleotide 116 ((Rp, Sp, Rp, Rp, Sp, Rp, Rp, Sp, Rp, Rp, Sp, Rp, Rp, Sp, Rp, Rp, Sp, Rp, Rp)d[GsCsCsTsCsAsGsT-sCsTsGsCsTsTsCsGsCsAsCsC] (SEQ ID NO: 106) (RS—(RRS)$_5$—RR))

Oligonucleotide 116 was synthesized as described above. RT in IEX-HPLC: 14.17 min. UPLC/ESI-MS: Calcd for $C_{191}H_{246}N_{67}O_{102}P_{19}S_{19}$: 6310.2; Found: 6312.4.

Results of Examples 2-16 are summarized in Table E-2, below:

DNA was synthesized using in-house prepared 2'-O-Methoxyethyl (MOE) phosphoramidites (Martin, P.; Helv.

TABLE E-2

Summary of Examples 2-16.

| Oligonucleotide | SEQ ID NO: | 5'-sequence-3' | Description of stereo-chemistry | RT-IEX (min) |
|---|---|---|---|---|
| 101 | 106 | d[GsCsCsTsCsAsGsTsCsTsGsCsTsTsCsGsCsAsCsC] | All-(Rp) | 14.70 |
| 102 | 106 | d[GsCsCsTsCsAsGsTsCsTsGsCsTsTsCsGsCsAsCsC] | All-(Sp) | 15.49 |
| 103 | 106 | d[GsCsCsTsCsAsGsTsCsTsGsCsTsTsCsGsCsAsCsC] | 5R-9S-5R | 15.10 |
| 104 | 106 | d[GsCsCsTsCsAsGsTsCsTsGsCsTsTsCsGsCsAsCsC] | 5S-9R-5S | 15.04 |
| 105 | 106 | d[GsCsCsTsCsAsGsTsCsTsGsCsTsTsCsGsCsAsCsC] | 1S-17R-1S | 14.75 |
| 106 | 106 | d[GsCsCsTsCsAsGsTsCsTsGsCsTsTsCsGsCsAsCsC] | 1R-17S-1R | 15.43 |
| 107 | 106 | d[GsCsCsTsCsAsGsTsCsTsGsCsTsTsCsGsCsAsCsC] | $(R/S)_9R$ | 15.02 |
| 108 | 106 | d[GsCsCsTsCsAsGsTsCsTsGsCsTsTsCsGsCsAsCsC] | $(S/R)_9S$ | 15.10 |
| 109 | 106 | d[GsCsCsTsCsAsGsTsCsTsGsCsTsTsCsGsCsAsCsC] | 3S-13R-3S | 14.91 |
| 110 | 106 | d[GsCsCsTsCsAsGsTsCsTsGsCsTsTsCsGsCsAsCsC] | 3R-13S-3R | 15.24 |
| 111 | 106 | d[GsCsCsTsCsAsGsTsCsTsGsCsTsTsCsGsCsAsCsC] | $18S/R^{19}$ | 15.69 |
| 113 | 106 | d[GsCsCsTsCsAsGsTsCsTsGsCsTsTsCsGsCsAsCsC] | $18S/R^2$ | 15.72 |
| 114 | 106 | d[GsCsCsTsCsAsGsTsCsTsGsCsTsTsCsGsCsAsCsC] | $(RRS)_6$-R | 14.14 |
| 115 | 106 | d[GsCsCsTsCsAsGsTsCsTsGsCsTsTsCsGsCsAsCsC] | S-$(RRS)_6$ | 14.30 |
| 116 | 106 | d[GsCsCsTsCsAsGsTsCsTsGsCsTsTsCsGsCsAsCsC] | RS-$(RRS)_5$-RR | 14.17 |

Example 17. Synthesis of Control Oligonucleotides

The control oligonucleotides (see Table E-3) were synthesized using the standard chemistry methods for automated solid-phase oligonucleotide synthesis (Beaucage, S. L. and Iyer, R. P., Tetrahedron, 1992, 48, 2223-2311). More specifically, stereorandom DNA was synthesized using standard DNA phosphoramidites (ChemGenes Co.), ethylthiotetrazole (ETT, Muang et al., Tetrahedron Lett., 2004, 45, 6497-6499) as the activator (Glen Research) and N,N-dimethyl-N'-(3-thioxo-3H-1,2,4-dithiazol-5-yl)methanimidamide (DDTT, AM Chemicals) as the sulfurizing reagent (Guzaev, A.; Tetrahedron Lett., 2011, 52, 434-437). The phosphoramidite coupling time was 2 min and the sulfurization time was 10 min. The oligonucleotide was deprotected and purified using standard methods. DNA phosphodiester was synthesized using standard DNA phosphoramidites, ETT as the activator and iodine/pyridine/water as the oxidizing reagent. 2'-O-Methoxyethyl (MOE)

Chim. Acta. 1995, 78, 486-504; Ross, B.; Song, Q.; 2004, US patent publication No. 20040082775), ETT as the activator and DDTT as the sulfurizing reagent. The times for coupling were 10 min and the times for sulfurization were 10 min. RNA was synthesized using standard RNA phosphoramidites (ChemGenes Co.), ETT as the activator and iodine/pyridine/water as the oxidizing reagent. The coupling times were 10 min.

All oligonucleotides were deprotected and purified using standard methods.

Purification of RNA (Oligonucleotide 117):

Waters 2525 BGM, 2487 Dual wavelength detector equipped with FCO and Flex injector Buffer A: 20 mM Sodium Phosphate pH=8.5

Buffer B: 20 mM Sodium Phosphate, 1 M NaBr pH=8.5

Column: AP-1 glass column from Waters, 10×200 mm, filled with Super Q-5PW (20), TSK Gel (Anion Exchange) from TOSOH Column Temperature: 70° C. (Timberline Instruments, TL600 mobile phase heater and TL150 Temperature controller)

Gradient Used:

| Time | Flow (mL/min) | % A | % B | Curve |
|---|---|---|---|---|
| Initial |  | 100 | 0 |  |
| 10 | 4 | 100 | 0 | 1 |
| 25 | 4 | 80 | 20 | 6 |
| 115 | 4 | 55 | 45 | 6 |
| 125 | 4 | 0 | 100 | 6 |
| 130 | 4 | 100 | 0 | 6 |
| 140 | 4 | 100 | 0 | 1 |

As shown in FIG. 1, the chirally controlled phosphorothioate diester 20-mer oligonucleotide (All-(Rp), Oligonucleotide 101, FIG. 1, A) has a different retention time than that of the phosphorothioate diester 20-mer standard stereorandom oligonucleotide (Oligonucleotide 118, FIG. 1, C) and has a sharper peak. One of skill in the art understands that during purification of the stereorandom oligonucleotide 108, it is likely that most of the all-(Rp) oligonucleotide (101, present in an approximately $\frac{1}{2}^{19}$ fraction of the mixture stereorandom oligonucleotide 108) would be lost.

Results of Example 17 are summarized in Table E-3, below.

TABLE E-3

Summary of Example 17.

| Oligonucleotide | SEQ ID NO: | 5'-sequence-3' | Description | RT (min) |
|---|---|---|---|---|
| 117 | 114 | GGUGCGAAGCAGACUGAGGC | RNA | 5.10 |
| 118 | 106 | d[GsCsCsTsCsAsGsTsCsTsGsCsTsTsCsGsCs AsCsC] | stereorandom | 15.04 |
| 119 | 106 | d[GCCTCAGTC TGC TTC GCACC] | DNA | 6.90 |
| 120 | 106 | (Gs5mCs5mCsTs5mCs)$_{MOE}$ d[AsGsTs5mCsTsGs5mCsTsTs5mCs](Gs5mCs As 5mCs5mC)$_{MOE}$ | stereorandom | 15.49 |
| 121 | 115 | d[GsAsTsGsCsCsTsCsTsCsCsTsAsCsGsCsGs CsCsT] | scrambled | 15.09 |

Procedures for Examples 18-21: The oligonucleotides containing stereodefined morpholinoethyl phosphorothioate triester internucleotidic linkages were synthesized on an ABI-394 DNA/RNA synthesizer according to the cycle summarized in Table E-4 using 1 µmol synthesis column and 0.8 µmol of oxalyl linked dC on HCP. The synthesis cycle was performed with removal of the terminal 5'-O-DMTr group (DMT Off). The solid support was washed with dry ACN and dried under a flux of argon. The dry HCP was placed in a plastic vial and was treated with 1 mL of dry propylamine in dry pyridine (in a 1:4 ratio) for a period of 18 h at r.t. The solvents were then evaporated and the residue was re-suspended with ~pH 1.5 aqueous solution containing 10% DMSO and the HCP support was filtered off. The crude product was purified by reverse phase preparative HPLC. The fractions having purity above 95% were pooled, concentrated and desalted by reverse-phase HPLC (Gradient of 0 to 80% ACN). The final desalted product was lyophilized from water.

TABLE E-4

Summary for Oligonucleotide Synthesis on a DNA/RNA Synthesizer ABI-394
Used for the Synthesis of Examples 18-21.

| step | reaction | reagent | delivery time (sec) | wait time (sec) |
|---|---|---|---|---|
| 1 | detritylation | 3% TCA in DCM | 3 + 60 + 10 | N.A. |
| 2 | coupling | 0.15 M phosphoramidite in ACN + 1.2 M CMPT in ACN | 5 + 4 | 30 + 600 |
| 3 | capping 1 | 5% Pac$_2$O in THF/2,6-lutidine | 20 | 60 |
| 4 | capping 2 | 5% Pac$_2$O in THF/2,6-lutidine + 16% NMI in THF | 20 | 60 |
| 5 | sulfurization | 0.3 M S-Morpholinoethyl-ToluylThioSulfonate | 10 + 4 × 2 | 30 + 3 × 150 + 600 |

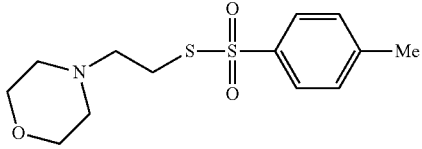

in ACN/BSTFA

General Purification Method for Examples 18-21:
Buffer A: 20 mM Phosphate pH=6.0 (adjusted with phosphoric acid)
Buffer B: ACN
Column: XBridge Prep C$_{18}$, 5 μm, C$_{18}$, 250×10 mm, Part #186003256
Buffer heater set temperature=50° C.
Signal monitored at 254 and 280 nm
Gradient Used:

| Time | Flow (ml/min) | % A | % B | Curve |
|---|---|---|---|---|
| Initial | | 99 | 1 | |
| 5 | 4 | 99 | 1 | 1 |
| 10 | 4 | 77 | 23 | 6 |
| 60 | 4 | 70 | 30 | 6 |
| 65 | 4 | 20 | 80 | 6 |
| 70 | 4 | 20 | 80 | 6 |
| 71 | 4 | 99 | 1 | 6 |
| 80 | 4 | 99 | 1 | 1 |

Analytical HPLC Methods for Oligonucleotides.
HPLC Method 1:
Buffer A: 20 mM Phosphate pH=6.0 (adjusted with phosphoric acid)
Buffer B: ACN
Column: XBridge C$_{18}$, 3.5 μm, C$_{18}$, 4.6×50 mm, Part #186003034
Buffer heater set temperature=35° C.
Signal monitored at 254 and 280 nm
Gradient Used:

| Time | Flow (ml/min) | % A | % B | Curve |
|---|---|---|---|---|
| Initial | | 95 | 5 | |
| 3 | 1 | 95 | 5 | 1 |
| 23 | 1 | 60 | 40 | 6 |
| 25 | 1 | 40 | 60 | 6 |
| 25.5 | 1 | 95 | 5 | 6 |
| 30 | 1 | 95 | 5 | 1 |

HPLC Method 2:
Buffer A: 50 mM TEAA, pH 7.8
Buffer B: ACN
Column: XBridge C$_{18}$, 3.5 μm, C$_{18}$, 4.6×50 mm, Part #186003034
Buffer heater set temperature=60° C.
Signal monitored at 254 and 280 nm
Gradient Used:

| Time | Flow (ml/min) | % A | % B | Curve |
|---|---|---|---|---|
| Initial | | 99 | 1 | |
| 2 | 1 | 99 | 1 | 1 |
| 22 | 1 | 65 | 35 | 6 |
| 25 | 1 | 5 | 95 | 6 |
| 25.5 | 1 | 5 | 95 | 6 |
| 30 | 1 | 99 | 1 | 1 |

HPLC Method 3:

| Time | Flow (ml/min) | % A | % B | Curve |
|---|---|---|---|---|
| Initial | | 85 | 15 | |
| 2 | 1 | 85 | 15 | 1 |
| 20 | 1 | 60 | 40 | 6 |
| 22 | 1 | 5 | 95 | 6 |
| 25 | 1 | 5 | 95 | 6 |
| 25.5 | 1 | 85 | 15 | 6 |
| 30 | 1 | 85 | 15 | 1 |

HPLC Method 4:

| Time | Flow (ml/min) | % A | % B | Curve |
|---|---|---|---|---|
| Initial |  | 85 | 15 |  |
| 2 | 1 | 85 | 15 | 1 |
| 20 | 1 | 40 | 60 | 6 |
| 22 | 1 | 5 | 95 | 6 |
| 25 | 1 | 5 | 95 | 6 |
| 25.5 | 1 | 85 | 15 | 6 |
| 30 | 1 | 85 | 15 | 1 |

Example 18. Synthesis of Oligonucleotide 122
(All-(Rp)-d
[Gs1Cs1Cs1Ts1Cs1As1Gs1Cs1Ts1Ts1Cs1Gs1Cs1Cs1C]
(SEQ ID NO: 106)

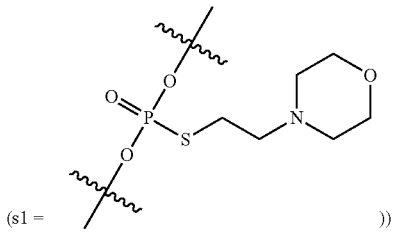

(s1 = )

Oligonucleotide 122 was synthesized as described above. RT in RP-HPLC: (HPLC method 1): 15.2 min. UPLC/ESI-MS: Calcd for $C_{305}H_{455}N_{86}O_{121}P_{19}S_{19}$: 8460.25; Found: 8462.0.

Example 19. Synthesis of Oligonucleotide 123
((Sp, Rp, Rp, Rp, Rp, Rp, Rp, Rp, Rp, Rp, Rp, Rp, Rp, Rp, Rp, Rp, Rp, Rp, Sp)-d
[Gs1Cs1Cs1Ts1Cs1As1Gs1Ts1Cs1Ts1Gs1Cs1Ts 1Ts1CsGs1Cs1As1Cs1C] (SEQ ID NO: 106) ((1S-17R-1S)

Oligonucleotide 123 was synthesized as described above. RT in RP-HPLC (HPLC method 1): 16.2 min. UPLC/ESI-MS: Calcd for $C_{305}H_{455}N_{86}O_{121}P_{19}S_{19}$: 8460.3; Found: 8461.5.

Example 20. Synthesis of Oligonucleotide 124
(All-(Sp)-d
[Gs1Cs1Cs1Ts1Cs1As1Gs1Ts1Cs1Ts1Gs1Cs1Ts1 Ts1Cs1Gs1Cs1As1Cs1C] (SEQ ID NO: 106))

Oligonucleotide 124 was synthesized as described above. RT in RP-HPLC (HPLC method 1): 18.3 min. UPLC/ESI-MS: Calcd for $C_{305}H_{455}N_{86}O_{121}P_{19}S_{19}$: 8460.3; Found: 8461.8.

Example 21. Synthesis of Oligonucleotide 125
(All-(Rp)-d[5mCs1As1Ts1G] (SEQ ID NO: 106))

Oligonucleotide 125 was synthesized as described above. RT in RP-HPLC (HPLC method 2): 16.32 min. UPLC/ESI-MS: Calcd for $C_{58}H_{85}N_{18}O_{22}P_3S_3$: 1575.5; Found: 1575.2.

In Examples 22 and 42 the oligonucleotide containing stereodefined methoxyethyl phosphorothioate triester internucleotidic linkages was synthesized on an ABI-394 DNA/RNA synthesizer according to the cycle summarized in Table E-5 using 1 µmol synthesis column and 0.8 µmol of oxalyl linked dC on HCP. The synthesis cycle was performed with removal of the terminal 5'-O-DMTr group (DMT Off). The solid support was washed with dry ACN and dried under a flux of argon. The dry HCP was placed in a plastic vial and was treated with 1 mL of dry propylamine in dry pyridine (in a 1:4 ratio) for a period of 18 h at r.t. The solvents were then evaporated and the residue was re-suspended with ~pH 1.5 aqueous solution containing 10% DMSO and the HCP support was filtered off. The crude product is purified by reverse phase preparative HPLC (Gradient of 5 to 65% ACN in 20 mM sodium phosphate buffer, pH=6.0). The fractions having purity above 95% are pooled, concentrated and desalted by reverse-phase HPLC (Gradient of 0 to 80% ACN). The final desalted product is lyophilized from water.

TABLE E-5

Summary for Oligonucleotide Synthesis on a DNA/RNA Synthesizer ABI-394
Used for the Synthesis of Examples 22 and 42.

| step | reaction | reagent | delivery time (sec) | wait time (sec) |
|---|---|---|---|---|
| 1 | detritylation | 3% TCA in DCM | 3 + 60 + 10 | N.A. |
| 2 | coupling | 0.15 M phosphoramidite in ACN + 1.2 M CMPT in ACN | 5 + 4 | 30 + 600 |
| 3 | capping 1 | 5% Pac₂O in THF/2,6-lutidine | 20 | 60 |
| 4 | capping 2 | 5% Pac₂O in THF/2,6-lutidine + 16% NMI in THF | 20 | 60 |

TABLE E-5-continued

Summary for Oligonucleotide Synthesis on a DNA/RNA Synthesizer ABI-394
Used for the Synthesis of Examples 22 and 42.

| step | reaction | reagent | delivery time (sec) | wait time (sec) |
|---|---|---|---|---|
| 5 | sulfurization | 0.3 M S-MOE Toluylthiosulfonate | 10 + 4 × 2 | 300 + 3 × 150 + 600 |

MeO–CH₂CH₂–S–S(=O)₂–C₆H₄–Me in ACN/BSTFA

Example 22. Synthesis of Oligonucleotide 126 (All-(Rp)-d[Cs2As2Gs2T])

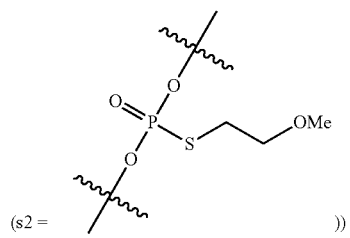

(s2 = )

Oligonucleotide 126 was synthesized as described above. RT in RP-HPLC (HPLC method 2): 16.23 min. UPLC/ESI-MS: Calcd for $C_{48}H_{68}N_{15}O_{22}P_3S_3$: 1396.2; Found: 1395.2.

Example 23

The oligonucleotide containing stereodefined N-methyl-piperazino bulky ester phosphorothioate triester internucleotidic linkages was synthesized on an ABI-394 DNA/RNA synthesizer according to the cycle summarized in Table E-6 using 1 μmol synthesis column and 1.5 μmol of oxalyl linked dT on HCP. The synthesis cycle was performed with removal of the terminal 5'-O-DMTr group (DMT Off). The solid support was washed with dry ACN and dried under a flux of argon. The dry HCP was placed in a plastic vial and was treated with 1 mL of dry propylamine in dry pyridine (in a 1:4 ratio) for a period of 18 h at r.t. The solvents were then evaporated and the residue was re-suspended with ~pH 1.5 aqueous solution containing 10% DMSO and the HCP support was filtered off. The crude product was purified by reverse phase preparative HPLC (Gradient of 5 to 65% ACN in 20 mM sodium phosphate buffer, pH=6.0). The fractions having purity above 95% were pooled, concentrated and desalted by reverse-phase HPLC (Gradient of 0 to 80% ACN). The final desalted product was lyophilized from water.

TABLE E-6

Summary for Oligonucleotide Synthesis on a DNA/RNA Synthesizer ABI-394
Used for the Synthesis of Example 23.

| step | reaction | reagent | delivery time (sec) | wait time (sec) |
|---|---|---|---|---|
| 1 | detritylation | 3% TCA in DCM | 3 + 60 + 10 | N.A. |
| 2 | coupling | 0.15 M phosphoramidite in ACN + 1.2 M CMPT in ACN | 5 + 4 | 30 + 600 |
| 3 | capping 1 | 5% Pac₂O in THF/2,6-lutidine | 20 | 60 |
| 4 | capping 2 | 5% Pac₂O in THF/2,6-lutidine + 16% NMI in THF | 20 | 60 |
| 5 | sulfurization | 0.3 M N-Methyl Piperazino ester PhenylThioSulfonate | 10 + 4 × 2 | 300 + 3 × 150 + 600 | in ACN/BSTFA

Example 23. Synthesis of Oligonucleotide 127
(All-(Rp)-d[Cs3As3Gs3T])

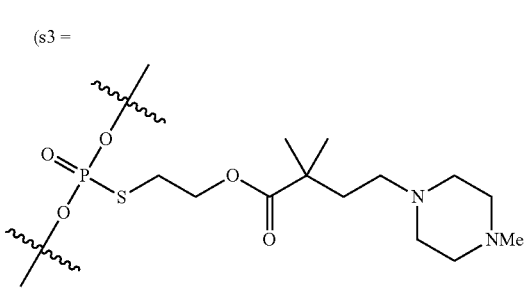

(s3 = )

Oligonucleotide 127 was synthesized as described above. RT in RP-HPLC (HPLC method 2): 20.24 min. UPLC/ESI-MS: Calcd for $C_{78}H_{122}N_{21}O_{25}P_3S_3$: 1943.1; Found: 1941.0.

Examples 24 and 43

The oligonucleotide containing stereodefined morpholino bulky ester phosphorothioate triester internucleotidic linkages was synthesized on an ABI-394 DNA/RNA synthesizer according to the cycle summarized in Table E-7 using 1 μmol synthesis column and 1.5 μmol of oxalyl linked dT on HCP. The synthesis cycle was performed with removal of the terminal 5'-O-DMTr group (DMT Off). The solid support was washed with dry ACN and dried under a flux of argon. The dry HCP was placed in a plastic vial and was treated with 1 mL of dry propylamine in dry pyridine (in a 1:4 ratio) for a period of 18 h at r.t. The solvents were then evaporated and the residue was re-suspended with ~pH 1.5 aqueous solution containing 10% DMSO and the HCP support was filtered off. The crude product is purified by reverse phase preparative HPLC (Gradient of 5 to 65% ACN in 20 mM sodium phosphate buffer, pH=6.0). The fractions having purity above 95% are pooled, concentrated and desalted by reverse-phase HPLC (Gradient of 0 to 80% ACN). The final desalted product is lyophilized from water.

Example 24. Synthesis of Oligonucleotide 128
(All-(Sp)-d[Cs4As4Gs4T])

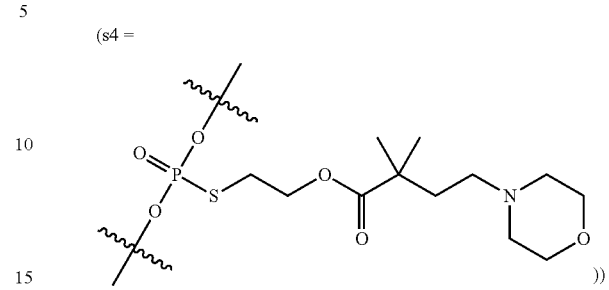

(s4 = )

Oligonucleotide 128 was synthesized as described above. RT in RP-HPLC (HPLC method 3): 19.75 min. UPLC/ESI-MS: Calcd for $C_5H_{13}N_{18}O_{28}P_3S_3$: 1902.9; Found: 1904.0.

Example 25

The oligonucleotide containing stereodefined dimethylaminoethyl phosphorothioate triester internucleotidic linkages was synthesized on an ABI-394 DNA/RNA synthesizer according to the cycle summarized in Table E-8 using 1 μmol synthesis column and 1.5 μmol of oxalyl linked dT on HCP. The synthesis cycle was performed with removal of the terminal 5'-O-DMTr group (DMT Off). The solid support was washed with dry ACN and dried under a flux of argon. The dry HCP was placed in a plastic vial and was treated with 1 mL of dry propylamine in dry pyridine (in a 1:4 ratio) for a period of 18 h at r.t. The solvents were then evaporated and the residue was re-suspended with ~pH 1.5 aqueous solution containing 10% DMSO and the HCP support was filtered off. The crude product was purified by reverse phase preparative HPLC (Gradient of 5 to 65% ACN in 20 mM sodium phosphate buffer, pH=6.0). The fractions having purity above 95% were pooled, concentrated and desalted by reverse-phase HPLC (Gradient of 0 to 80% ACN). The final desalted product was lyophilized from water.

TABLE E-7

Summary for Oligonucleotide Synthesis on a DNA/RNA Synthesizer ABI-394 Used for the Synthesis of Examples 24 and 43.

| step | reaction | reagent | delivery time (sec) | wait time (sec) |
|---|---|---|---|---|
| 1 | detritylation | 3% TCA in DCM | 3 + 60 + 10 | N.A. |
| 2 | coupling | 0.15 M phosphoramidite in ACN + 1.2 M CMPT in ACN | 5 + 4 | 30 + 600 |
| 3 | capping 1 | 5% Pac$_2$O in THF/2,6-lutidine | 20 | 60 |
| 4 | capping 2 | 5% Pac$_2$O in THF/2,6-lutidine + 16% NMI in THF | 20 | 60 |
| 5 | sulfurization | 0.3 M morpholino ester NitroPhenylThioSulfonate | 10 + 4 × 2 | 300 + 3 × 150 + 600 | in ACN/BSTFA

TABLE E-8

Summary for Oligonucleotide Synthesis on a DNA/RNA Synthesizer ABI-394
Used for the Synthesis of Examples 25.

| step | reaction | reagent | delivery time (sec) | wait time (sec) |
|---|---|---|---|---|
| 1 | detritylation | 3% TCA in DCM | 3 + 60 + 10 | N.A. |
| 2 | coupling | 0.15 M phosphoramidite in ACN + 1.2 M CMPT in ACN | 5 + 4 | 30 + 600 |
| 3 | capping 1 | 5% Pac$_2$O in THF/2,6-lutidine | 20 | 60 |
| 4 | capping 2 | 5% Pac$_2$O in THF/2,6-lutidine + 16% NMI in THF | 20 | 60 |
| 5 | sulfurization | 0.3 M dimethylaminoethyl-ToluylThioSulfonate [structure] in ACN/BSTFA | 10 + 4 × 2 | 900 + 3 × 600 + 900 |

Example 25. Synthesis of Oligonucleotide 129 (All-(Sp)-d[Cs5As5Gs5T])

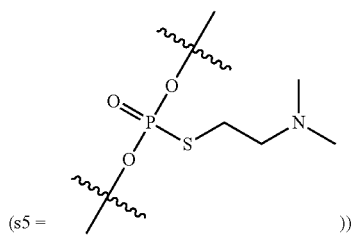

(s5 = )

Oligonucleotide 129 was synthesized as described above. RT in RP-HPLC (HPLC method 2): 17.25 min. UPLC/ESI-MS: Calcd for $C_{51}H_{77}N_{18}O_{19}P_3S_3$: 1435.4; Found: 1435.0.

Example 26

The oligonucleotide containing stereodefined dimethylalanine ester phosphorothioate triester internucleotidic linkages was synthesized on an ABI-394 DNA/RNA synthesizer according to the cycle summarized in Table E-9 using 1 μmol synthesis column and 1.5 μmol of oxalyl linked dT on HCP. The synthesis cycle was performed with removal of the terminal 5'-O-DMTr group (DMT Off). The solid support was washed with dry ACN and dried under a flux of argon. The dry HCP was placed in a plastic vial and was treated with 1 mL of dry propylamine in dry pyridine (in a 1:4 ratio) for a period of 18 h at r.t. The solvents were then evaporated and the residue was re-suspended with ~pH 1.5 aqueous solution containing 10% DMSO and the HCP support was filtered off. The crude product is purified by reverse phase preparative HPLC (Gradient of 5 to 65% ACN in 20 mM sodium phosphate buffer, pH=6.0). The fractions having purity above 95% are pooled, concentrated and desalted by reverse-phase HPLC (Gradient of 0 to 80% ACN). The final desalted product is lyophilized from water.

TABLE E-9

Summary for Oligonucleotide Synthesis on a DNA/RNA Synthesizer ABI-394
Used for the Synthesis of Examples 26.

| step | reaction | reagent | delivery time (sec) | wait time (sec) |
|---|---|---|---|---|
| 1 | detritylation | 3% TCA in DCM | 3 + 60 + 10 | N.A. |
| 2 | coupling | 0.15 M phosphoramidite in ACN + 1.2 M CMPT in ACN | 5 + 4 | 30 + 600 |
| 3 | capping 1 | 5% Pac$_2$O in THF/2,6-lutidine | 20 | 60 |
| 4 | capping 2 | 5% Pac$_2$O in THF/2,6-lutidine + 16% NMI in THF | 20 | 60 |

TABLE E-9-continued

Summary for Oligonucleotide Synthesis on a DNA/RNA Synthesizer ABI-394 Used for the Synthesis of Examples 26.

| step | reaction | reagent | delivery time (sec) | wait time (sec) |
|---|---|---|---|---|
| 5 | sulfurization | 0.3 M dimethylalanine-Fmoc ester NitroPhenylThioSulfonate | 10 + 4 × 2 | 900 + 3 × 600 + 900 |

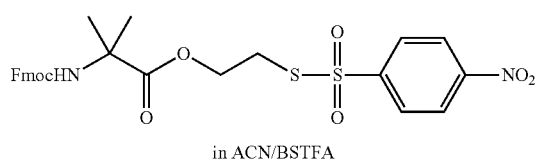

in ACN/BSTFA

Example 26. Synthesis of Oligonucleotide 130 (All-(Sp)-d[Cs6As6Gs6T]

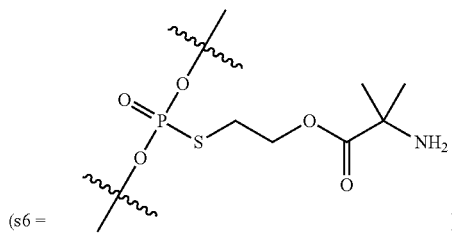

Oligonucleotide 130 was synthesized as described above. RT in RP-HPLC (HPLC method 2): 16.45 min. UPLC/ESI-MS: Calcd for $C_{57}H_{83}N_{18}O_{25}P_3S_3$: 1609.5; Found: 1609.6.

Examples 27 and 28

The oligonucleotide containing stereodefined S-methyl phosphorothioate triester internucleotidic linkages was synthesized on an ABI-394 DNA/RNA synthesizer according to the cycle summarized in Table E-10 using 1 μmol synthesis column and 0.8 μmol of oxalyl linked dC on HCP. The synthesis cycle was performed with removal of the terminal 5'-O-DMTr group (DMT Off). The solid support was washed with dry ACN and dried under a flux of argon. The dry HCP was placed in a plastic vial and was treated with 1 mL of dry propylamine in dry pyridine (in a 1:4 ratio) with 50% DMSO for a period of 18 h at r.t. The solvents were then evaporated and the residue was re-suspended with ~pH 1.5 aqueous solution containing 10% DMSO and the HCP support was filtered off. The crude product is purified by reverse phase preparative HPLC (Gradient of 5 to 65% ACN in 20 mM sodium phosphate buffer, pH=6.0). The fractions having purity above 95% are pooled, concentrated and desalted by reverse-phase HPLC (Gradient of 0 to 80% ACN). The final desalted product is lyophilized from water.

TABLE E-10

Summary for Oligonucleotide Synthesis on a DNA/RNA Synthesizer ABI-394 Used for the Synthesis of Examples 27 and 28.

| step | reaction | reagent | delivery time (sec) | wait time (sec) |
|---|---|---|---|---|
| 1 | detritylation | 3% TCA in DCM | 3 + 60 + 10 | N.A. |

TABLE E-10-continued

Summary for Oligonucleotide Synthesis on a DNA/RNA Synthesizer ABI-394 Used for the Synthesis of Examples 27 and 28.

| step | reaction | reagent | delivery time (sec) | wait time (sec) |
|---|---|---|---|---|
| 2 | coupling | 0.15M phosphoramidite in ACN + 1.2M CMPT in ACN | 5 + 4 | 30 + 600 |
| 3 | capping 1 | 5% Pac₂O in THF/2,6-lutidine | 20 | 60 |
| 4 | capping 2 | 5% Pac₂O in THF/2,6-lutidine + 16% NMI in THF | 20 | 60 |
| 5 | sulfurization | 0.3M S-methyl NitroPhenylThioSulfonate | 10 + 4 × 2 | 300 + 3 × 150 + 600 |

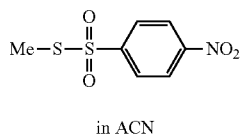

in ACN

Example 27. Synthesis of Oligonucleotide 131 (All-(Rp)-d [Gs7Cs7Cs7Ts7Cs7As7Gs7Ts7Cs7Ts7Gs7Cs7Ts7 Ts7Cs7Gs7Cs7As7Cs7C] (SEQ ID NO: 106)

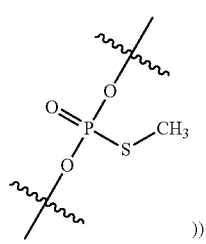

Oligonucleotide 131 was synthesized as described above. RT in RP-HPLC: 27.65 min. UPLC/ESI-MS: Calcd for $C_{210}H_{284}N_{67}O_{102}P_{19}S_{19}$: 6576.71; Found: 6575. 6.

Example 28. Synthesis of Oligonucleotide 132
(All-(Sp)-d
[Gs7Cs7Cs7Ts7Cs7As7Gs7Ts7Cs7Ts7Gs7Cs7Ts7
Ts7Cs7Gs7Cs7As7Cs7C] (SEQ ID NO: 106)

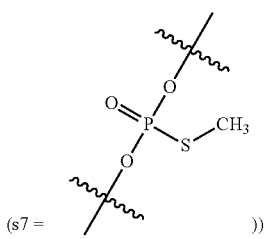

(s7 = )

The synthesis cycle was performed with removal of the terminal 5'-O-DMTr group (DMT Off). After completion of the automated oligonucleotide synthesis, the HCP support was washed with dry ACN and dried under vacuum. The dry HCP was placed in a plastic vial and was treated with 1 mL of dry propylamine in dry pyridine (in a 1:4 ratio) for a period of 18 h at r.t. The solvents were then evaporated and the residue was re-suspended with ~pH 1.5 aqueous solution containing 10% DMSO and the HCP support was filtered off. The crude product is purified by reverse phase preparative HPLC (According to the procedure described below). The fractions having purity above 95% are pooled, concentrated and desalted by reverse-phase HPLC (Gradient of 0 to 30% ACN). The final desalted product is lyophilized from water.

TABLE E-11

Summary for Oligonucleotide Synthesis on a DNA/RNA Synthesizer ABI-394 Used for the Synthesis of Examples 29-41.

| step | reaction | reagent | delivery time (sec) | wait time (sec) |
|---|---|---|---|---|
| 1 | detritylation | 3% TCA in DCM | 3 + 60 + 10 | N.A. |
| 2 | coupling | 0.15M phosphoramidite in ACN + 1.2M CMPT in ACN | 5 + 4 | 30 + 600 |
| 3 | capping 1 | 5% Pac$_2$O in THF/2,6-lutidine | 20 | 60 |
| 4 | capping 2 | 5% Pac$_2$O in THF/2,6-lutidine + 16% NMI in THF | 20 | 60 |
| 5 | sulfurization | 0.3M S-Morpholinoethyl ToluylThioSulfonate | 10 + 4 × 2 | 300 + 3 × 150 + 600 | in ACN/BSTFA

Oligonucleotide 132 was synthesized as described above. RT in RP-HPLC: 32.65 min. UPLC/ESI-MS: Calcd for $C_{210}H_{284}N_{67}O_{102}P_{19}S_{19}$: 6576.71; Found: 6574.8.

Synthesis of Chirally Controlled Oligonucleotides Comprising Modified Nucleobases As generally described above and herein, in some embodiments, the present invention provides chirally controlled oligonucleotides comprising oligonucleotides other than A, T, C and G. In some embodiments, such chirally controlled oligonucleotides comprise 5-methylcytosine (5mC). Non-limiting examples are presented in Examples 21 and below.

Examples 29-41 were synthesized using the automated synthesis on ABI-394 DNA/RNA synthesizer according to the synthetic cycle summarized on Table E-11, using 1 µmol synthesis column and 1.75 mol of oxalyl linked dG on HCP.

General Purification Method for Examples 29-41:

Buffer A: 20 mM Phosphate pH=6.0 (adjusted with phosphoric acid)

Buffer B: ACN

Column: XBridge Prep Cs$_{18}$, 5 µm, C$_{18}$, 250×10 mm, Part #186003256

Buffer heater set temperature=50° C.

Signal monitored at 254 and 280 nm

Gradient Used:

| Time | Flow (ml/min) | % A | % B | Curve |
|---|---|---|---|---|
| Initial | | 99 | 1 | |
| 5 | 4 | 99 | 1 | 1 |
| 10 | 4 | 77 | 23 | 6 |
| 60 | 4 | 70 | 30 | 6 |
| 65 | 4 | 20 | 80 | 6 |
| 70 | 4 | 20 | 80 | 6 |
| 71 | 4 | 99 | 1 | 6 |
| 80 | 4 | 99 | 1 | 1 |

Example 29. Synthesis of Oligonucleotide 135 (All-(Rp)-d [5mCs1As1Gs1Ts15mCs1Ts1Gs15mCs1Ts1Ts15mCs1G] (SEQ ID NO: 108))

Oligonucleotide 135 was synthesized as described above. RT in RP-HPLC (HPLC method 1): 17.50 min. UPLC/ESI-MS: Calcd for $C_{186}H_{278}N_{51}O_{73}P_{11}S_{11}$: 5090.0; Found: 5091.9.

Example 30. Synthesis of Oligonucleotide 136 (All-(Sp)-d [5mCs1As1Gs1Ts15mCs1Ts1Gs15mCs1Ts1Ts15mCs1G] (SEQ ID NO: 108))

Oligonucleotide 136 was synthesized as described above. RT in RP-HPLC (HPLC method 1): 19.25 min. UPLC/ESI-MS: Calcd for $C_{186}H_{278}N_{51}O_{73}P_{11}S_{11}$: 5090.0; Found: 5090.8.

Example 31. Synthesis of Oligonucleotide 137 ((Sp, Rp, Rp, Rp, Rp, Rp, Rp, Rp, Rp, Rp, Sp)-d [5mCs1As1Gs1Ts15mCs1Ts1Gs15mCs1Ts1Ts15mCs1G] (SEQ ID NO: 108) (1S-9R-1S))

Oligonucleotide 137 was synthesized as described above. RT in RP-HPLC (HPLC method 1): 17.85 min. UPLC/ESI-MS: Calcd for $C_{186}H_{278}N_{51}O_{73}P_{11}S_{11}$: 5090.0; Found: 5091.9.

Example 32. Synthesis of Oligonucleotide 138 ((Sp, Sp, Rp, Rp, Rp, Rp, Rp, Rp, Rp, Sp, Sp)-d [5mCs1As1Gs1Ts15mCs1Ts1Gs15mCs1Ts1s15mCs1G] (SEQ ID NO: 108) (2S-7R-2S))

Oligonucleotide 138 was synthesized as described above. RT in RP-HPLC (HPLC method 1): 18.10 min. UPLC/ESI-MS: Calcd for $C_{186}H_{278}N_{51}O_{73}P_{11}S_{11}$: 5090.0; Found: 5091.9.

Example 33. Synthesis of Oligonucleotide 139 ((Rp, Sp, Sp, Sp, Sp, Sp, Sp, Sp, Sp, Sp, Rp)-d [5mCs1As1Gs1Ts15mCs1Ts1Gs15mCs1Ts1Ts15mCs1G] (SEQ ID NO: 108) (1R-9S-1R))

Oligonucleotide 139 was synthesized as described above. RT in RP-HPLC (HPLC method 1): 18.75 min. UPLC/ESI-MS: Calcd for $C_{186}H_{278}N_{51}O_{73}P_{11}S_{11}$: 5090.0; Found: 5088.9.

Example 34. Synthesis of Oligonucleotide 140 ((Rp, Rp, Sp, Sp, Sp, Sp, Sp, Sp, Sp, Rp, Rp)-d [5mCs1As1Gs1Ts15mCs1Ts1Gs15mCs1Ts1Ts15mCs1G] (SEQ ID NO: 108) (2R-7S-2R))

Oligonucleotide 140 was synthesized as described above. RT in RP-HPLC (HPLC method 1): 18.72 min. UPLC/ESI-MS: Calcd for $C_{186}H_{278}N_{51}O_{73}P_{11}S_{11}$: 5090.0; Found: 5091.3.

Example 35. Synthesis of Oligonucleotide 141 ((Sp, Sp, Sp, Rp, Rp, Rp, Rp, Rp, Sp, Sp, Sp)-d [5mCs1As1Gs1Ts15mCs1Ts1Gs15mCs1Ts1Ts15mCs1G] (SEQ ID NO: 108) (3S-5R-3S))

Oligonucleotide 141 was synthesized as described above. RT in RP-HPLC (HPLC method 1): 18.09 min. UPLC/ESI-MS: Calcd for $C_{186}H_{278}N_{51}O_{73}P_{11}S_{11}$: 5090.0; Found: 5090.9.

Example 36. Synthesis of Oligonucleotide 142 ((Rp, Rp, Rp, Sp, Sp, Sp, Sp, Sp, Rp, Rp, Rp)-d [5mCs1As1Gs1Ts15mCs1Ts1Gs15mCs1Ts1Ts15mCs1G] (SEQ ID NO: 108) (3R-5S-3R))

Oligonucleotide 142 was synthesized as described above. RT in RP-HPLC: 18.35 min. UPLC/ESI-MS (HPLC method 1): Calcd for $C_{186}H_{278}N_{51}O_{73}P_{11}S_{11}$: 5090.0; Found: 5088.9.

Example 37. Synthesis of Oligonucleotide 143 ((Sp, Sp, Rp, Sp, Sp, Rp, Sp, Sp, Rp, Sp, Sp)-d [5mCs1As1Gs1Ts15mCs1Ts1Gs1s15mCs1Ts15mCs1G] (SEQ ID NO: 108) ((SSR)$_3$—SS))

Oligonucleotide 143 was synthesized as described above. RT in RP-HPLC (HPLC method 1): 18.48 min. UPLC/ESI-MS: Calcd for $C_{186}H_{278}N_{51}O_{73}P_{11}S_{11}$: 5090.0; Found: 5092.0.

Example 38. Synthesis of Oligonucleotide 144 ((Rp, Rp, Sp, Rp, Rp, Sp, Rp, Rp, Sp, Rp, Rp)-d [5mCs1As1Gs1Ts15mCs1Ts1Gs15mCs1Ts1Ts15mCs1G] (SEQ ID NO: 108) ((RRS)$_3$—RR))

Oligonucleotide 144 was synthesized as described above. RT in RP-HPLC (HPLC method 1): 18.02 min. UPLC/ESI-MS: Calcd for $C_{186}H_{278}N_{51}O_{73}P_{11}S_{11}$: 5090.0; Found: 5091.4.

Example 39. Synthesis of Oligonucleotide 145 (All-(Rp)-d [5mCs1Ts15mCs1As1Gs1Ts15mCs1Ts1Gs15mCs1Ts1Ts15mCs1Gs15mC] (SEQ ID NO: 108))

Oligonucleotide 145 was synthesized as described above. RT in RP-HPLC (HPLC method 1): 17.30 min. UPLC/ESI-MS: Calcd for $C_{234}H_{352}N_{62}O_{92}P_{14}S_{14}$: 6388.3; Found: 6390.6.

Example 40. Synthesis of Oligonucleotide 146 (All-(Rp)-d[Gs15mCs1Ts1G])

Oligonucleotide 146 was synthesized as described above. RT in RP-HPLC (HPLC method 2): 15.89 min. UPLC/ESI-MS: Calcd for $C_{58}H_{85}N_{18}O_{23}P_3S_3$: 1591.5; Found: 1590.8.

Example 41. Synthesis of Oligonucleotide 147 (All-(Rp)-d[5mCs1As1Gs1T])

Oligonucleotide 147 was synthesized as described above. RT in RP-HPLC (HPLC method 2): 16.30 min. UPLC/ESI-MS: Calcd for $C_{58}H_{85}N_{18}O_{22}P_3S_3$: 1575.5; Found: 1575.2.

Example 42. Synthesis of Oligonucleotide 148 (All-(Rp)-d [5mCs2As2Gs2Ts25mCs2Ts2Gs25mCs2Ts2Ts25mCs2G] (SEQ ID NO: 108)

Oligonucleotide 148 was synthesized as described above, using the sulfurization reagent in Example 22. RT in RP-HPLC (HPLC method 3): 16.51 min. UPLC/ESI-MS: Calcd for $C_{153}H_{223}N_{40}O_{73}P_{11}S_{11}$: 4484.1; Found: 4483.0.

Example 43. Synthesis of Oligonucleotide 149 (All-(Rp)-d [5mCs4As4Gs4Ts45mCs4Ts4Gs45mCs4Ts4Ts45m Cs4G] (SEQ ID NO: 108))

Oligonucleotide 149 was synthesized as described above, using the sulfurization reagent in Example 24. RT in RP-HPLC (HPLC method 4): 17.87 min. UPLC/ESI-MS: Calcd for $C_{252}H_{388}N_{51}O_{95}P_{11}S_{11}$: 6345.6; Found: 6346.5.

Synthesis of Chirally Controlled Chimeric Oligonucleotides Comprising Different Internucleotidic Linkages As generally described above and herein, in some embodiments, the present invention provides chirally controlled oligonucleotide comprising different internucleotidic linkages. The non-limiting examples below illustrate such chirally controlled oligonucleotides, and the methods of synthesizing the same.

Examples 44-45 illustrate the synthesis of chirally controlled chimeric oligonucleotide comprising different internucleotidic linkages. The oligonucleotides containing mixed diastereomerically pure morpholinoethyl phosphorothioate triester/phosphorothioate diester internucleotidic linkages were synthesized on an ABI-394 DNA/RNA synthesizer according to the cycle summarized in Table E-12 using 1 μmol synthesis column and 1.5 μmol of oxalyl linked dT on HCP. As each iterative cycle allows for a different sulfurization reagent to be reacted, two different thiosulfonates were used. The synthesis was performed with removal of the terminal 5'-O-DMTr group (DMT Off). The solid support was washed with dry ACN and dried under a flux of argon. The dry solid support was then treated with 5 mL of anhydrous 1 M solution of 1,5-diazabicyclo(4.3.0)non-5-ene (DBN) in dry ACN-trimethylsilyl chloride—16:1 (v/v) for 10 min at r.t. The DBN solution was slowly pushed through the column by means of a plastic luer syringe fixed to the outlet of the column. The support was then washed with dry ACN and dried under vacuum. The dry HCP was placed in a plastic vial and was treated with 1 mL of dry propylamine in dry pyridine (in a 1:4 ratio) for a period of 18 h at r.t. The solvents were then evaporated and the residue was re-suspended with ~pH 1.5 aqueous solution containing 10% DMSO and the HCP support was filtered off. The crude product is purified by reverse phase preparative HPLC (Gradient of 5 to 65% ACN in 20 mM sodium phosphate buffer, pH=6.0). The fractions having purity above 95% are pooled, concentrated and desalted by reverse-phase HPLC (Gradient of 0 to 80% ACN). The final desalted product is lyophilized from water.

TABLE E-12

Summary for Oligonucleotide Synthesis on a DNA/RNA Synthesizer ABI-394 Used for the Synthesis of Examples 44-45.

| step | reaction | reagent | delivery time (sec) | wait time (sec) |
|---|---|---|---|---|
| 1 | detritylation | 3% TCA in DCM | 3 + 60 + 10 | N.A. |
| 2 | coupling | 0.15M phosphoramidite in ACN + 1.2M CMPT in ACN | 5 + 4 | 30 + 600 |
| 3 | capping 1 | 5% Pac$_2$O in THF/2,6-lutidine | 20 | 60 |
| 4 | capping 2 | 5% Pac$_2$O in THF/2,6-lutidine + 16% NMI in THF | 20 | 60 |
| 5 | sulfurization 1 | 0.3M S-Morpholinoethyl Toluylthiosulfonate (structure shown) in ACN/BSTFA | 10 + 4 × 2 | 300 + 3 × 150 + 600 |
| 6 | sulfurization 2 | 0.3M S-cyanoethyl Methylthiosulfonate (structure shown) in ACN/BSTFA | 10 + 4 × 2 | 300 + 3 × 150 + 600 |

Example 44. Synthesis of Oligonucleotide 150 (All-(Rp)-d[Ts1Cs1AsT])

Oligonucleotide 150 was synthesized as described above. RT in RP-HPLC (HPLC method 2): 12.72 min. UPLC/ESI-MS: Calcd for $C_{45}H_{62}N_{13}O_{21}P_3S_3$: 1310.2; Found: 1309.2.

Example 45. Synthesis of Oligonucleotide 151 (All-(Sp)-d[Cs1AsGs1T])

Oligonucleotide 151 was synthesized as described above. RT in RP-HPLC (HPLC method 2): 14.71 min. UPLC/ESI-MS: Calcd for $C_{51}H_{72}N_{17}O_{21}P_3S_3$: 1448.4; Found: 1446.9.

Example 46 describes the synthesis of chirally controlled chimeric oligonucleotide comprising both phosphate diester internucleotidic linkage and modified internucleotidic linkages. The exemplary oligonucleotides containing mixed morpholinoethyl phosphorothioate tri ester/phosphodiester internucleotidic linkages were synthesized on an ABI-394 DNA/RNA synthesizer according to the cycle summarized in Table E-13 using 1 μmol synthesis column and 1.5 μmol of oxalyl linked dT on HCP. As each iterative cycle allows for different sulfurization or oxidation reagents to be reacted, one thiosulfonate reagent was used for sulfurization in one cycle and iodine-promoted oxidation was used in another cycle. The synthesis was performed with removal of the terminal 5'-O-DMTr group (DMT Off). The solid support was washed with dry ACN and dried under a flux of argon. The dry HCP was placed in a plastic vial and was treated with 1 mL of dry propylamine in dry pyridine (in a 1:4 ratio) for a period of 18 h at r.t. The solvents were then evaporated and the residue was re-suspended with ~pH 1.5 aqueous solution containing 10% DMSO and the HCP support was filtered off. The crude product was purified by reverse phase preparative HPLC (Gradient of 5 to 65% ACN in 20 mM sodium phosphate buffer, pH=6.0). The fractions having purity above 95% were pooled, concentrated and desalted by reverse-phase HPLC (Gradient of 0 to 80% ACN). The final desalted product was lyophilized from water.

phosphorothioate diester linkages were synthesized on an ABI-394 DNA/RNA synthesizer according to the cycle summarized in Table E-14 using 1 μmol synthesis column and 1.5 μmol of oxalyl linked dT on HCP. As each iterative cycle allows for different sulfurization or oxidation reagents to be reacted, two different thiosulfonate reagents were used for the two different sulfurization cycles and iodine-promoted oxidation was used for another cycle. The synthesis was performed with removal of the terminal 5'-O-DMTr group (DMT Off). The solid support was washed with dry ACN and dried under a flux of argon. The dry solid support was then treated with 5 mL of anhydrous 1 M solution of 1,5-diazabicyclo(4.3.0)non-5-ene (DBN) in dry ACN-trimethylsilyl chloride—16:1 (v/v) for 10 min at r.t. The DBN solution was slowly pushed through the column by means of a plastic luer syringe fixed to the outlet of the column. The support was then washed with dry ACN and dried under

TABLE E-13

Summary for Oligonucleotide Synthesis on a DNA/RNA Synthesizer ABI-394 Used for the Synthesis of Example 46.

| step | reaction | reagent | delivery time (sec) | wait time (sec) |
|---|---|---|---|---|
| 1 | detritylation | 3% TCA in DCM | 3 + 60 + 10 | N.A. |
| 2 | coupling | 0.15M phosphoramidite in ACN + 1.2M CMPT in ACN | 5 + 4 | 30 + 600 |
| 3 | capping 1 | 5% Pac$_2$O in THF/2,6-lutidine | 20 | 60 |
| 4 | capping 2 | 5% Pac$_2$O in THF/2,6-lutidine + 16% NMI in THF | 20 | 60 |
| 5 | sulfurization | 0.3M S-Morpholinoethyl Toluylthiosulfonate in ACN/BSTFA | 10 + 4 × 2 | 300 + 3 × 150 + 600 |
| 6 | oxidation | 0.02M I$_2$, Pyridine/Water | 10 | 300 |

Example 46. Synthesis of Oligonucleotide 152 (All-(Sp)-d[CsIAGs1T])

Oligonucleotide 152 was synthesized as described above. RT in RP-HPLC (HPLC method 2): 13.42 min. UPLC/ESI-MS: Calcd for $C_{51}H_{72}N_{17}O_{22}P_3S_2$: 1432.3; Found: 1431.7.

Example 47 describes the synthesis of chirally controlled chimeric oligonucleotide comprising a phosphodiester internucleotidic linkage and both modified chirally pure phosphotriester and phosphodiester internucleotidic linkages. The chirally controlled oligonucleotides containing mixed morpholinoethyl phosphorothioate triester/phosphodiester/ vacuum. The dry HCP was placed in a plastic vial and was treated with 1 mL of dry propylamine in dry pyridine (in a 1:4 ratio) for a period of 18 h at r.t. The solvents were then evaporated and the residue was re-suspended with pH 1.5 aqueous solution containing 10% DMSO and the HCP support was filtered off. The crude product was purified by reverse phase preparative HPLC (Gradient of 5 to 65% ACN in 20 mM sodium phosphate buffer, pH=6.0). The fractions having purity above 95% were pooled, concentrated and desalted by reverse-phase HPLC (Gradient of 0 to 80% ACN). The final desalted product was lyophilized from water.

TABLE E-14

Summary for Oligonucleotide Synthesis on a DNA/RNA Synthesizer ABI-394 Used for the Synthesis of Example 47.

| step | reaction | reagent | delivery time (sec) | wait time (sec) |
|---|---|---|---|---|
| 1 | detritylation | 3% TCA in DCM | 3 + 60 + 10 | N.A. |
| 2 | coupling | 0.15M phosphoramidite in ACN + 1.2M CMPT in ACN | 5 + 4 | 30 + 600 |
| 3 | capping 1 | 5% Pac$_2$O in THF/2,6-lutidine | 20 | 60 |
| 4 | capping 2 | 5% Pac$_2$O in THF/2,6-lutidine + 16% NMI in THF | 20 | 60 |
| 5 | sulfurization 1 | 0.3M S-cyanoethyl MethylThioSulfonate | 10 + 4 × 2 | 300 + 3 × 150 + 600 |
|   |   | [structure: Me-CH2CH2-S-S(=O)(=O)-Me] in ACN/BSTFA | | |
| 6 | sulfurization 2 | 0.3M S-Morpholinoethyl ToluylThioSulfonate | 10 + 4 × 2 | 300 + 3 × 150 + 600 |
|   |   | [structure: morpholino-CH2CH2-S-S(=O)(=O)-C6H4-Me] in ACN/BSTFA | | |
| 7 | oxidation | 0.02M I$_2$, Pyridine/Water | 10 | 300 |

Example 47. Synthesis of Oligonucleotide 153 (All-(Sp)-d[CAs1GsT])

Oligonucleotide 153 was synthesized as described above. RT in RP-HPLC (HPLC method 2): 11.48 min. UPLC/ESI-MS: Calcd for $C_{45}H_{61}N_{16}O_{21}P_3S_2$: 1318.1; Found: 1318.1.

As will be appreciated by a person skilled in the art, following examples 46 and 47, and other examples and methods described herein, longer chimeric chirally controlled oligonucleotides can be prepared.

Chirally Pure Oligonucleotides have Different Properties than the Mixture of Diastereomers from Non-Stereospecific Synthesis As described above and herein, in some embodiments, the present application provides chirally pure oligonucleotides that have different chemical and biological properties than the mixture of diastereomers with the same base sequence but synthesized through non-stereospecific oligonucleotide synthesis.

Example 48. HPLC Profile of Chirally Pure Oligonucleotides and Mixture of Diastereomers from Non-Stereospecific Synthesis Chirally pure phosphorothioate diester oligonucleotides A (Full R$_P$, Oligonucleotide 101) and B (Full S$_P$, Oligonucleotide 102) and non-stereospecific C (stereorandom phosphorothioate diester internucleotidic linkages), which was made by standard non-stereospecific oligonucleotide synthesis, were analyzed by the same RP-HPLC conditions and the corresponding HPLC traces are represented on FIG. 2.

Figure 2:
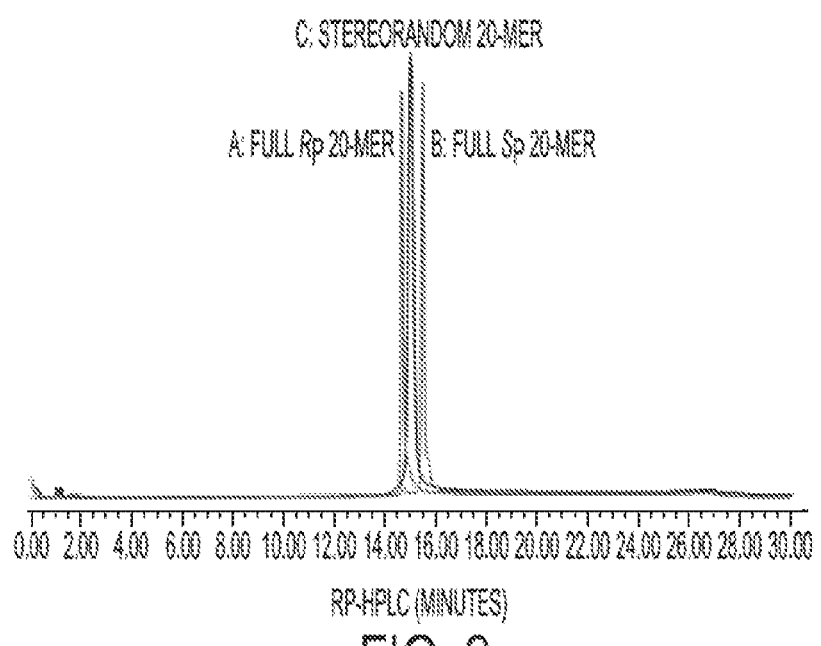
FIG. 2. HPLC of chirally controlled oligonucleotides and stereorandom oligonucleotide. A: Oligonucleotide 101 (all-Rp); B: Oligonucleotide 102 (all-Sp); and C: Oligonucleotide 118 (stereorandom).

As clearly demonstrated in FIG. 2, the stereochemistry of the phosphorothioate diester 20-mer oligonucleotides affects their behavior as determined by RP-HPLC and IEX-HPLC.

Without the intention to be limited by theory, a correlation is observed between the retention times (RT) obtained by RP-HPLC and IEX-HPLC, as RT trends are conserved. The full R$_P$ stereoisomer (A) has a shorter retention than the full S$_P$ stereoisomer (B), while the stereorandom phosphorothioate diester oligonucleotide (C), being a mixture of all $2^{19}$ stereoisomers, has a broad HPLC peak, eluting between the extreme full R$_P$ and full S$_P$ diastereoisomers.

As will be appreciated by those skilled in the art, the presented data herewith confirm that depicted analyses comparing different chirally controlled or uncontrolled (e.g., stereorandom) oligonucleotide compositions of the same sequence show that the exemplified chirally uncontrolled oligonucleotide composition (i.e., as prepared by non-chiral controlled oligonucleotide synthesis), includes only an extremely low level of certain oligonucleotide types, such as the full Rp or Sp type.

Example 49. Thermal Denaturation Experiment (Tm)

Each DNA strand was mixed with complementary RNA in equimolar concentration of 0.5 µM in 1×PBS. Total 2.5 mL solution was prepared for each duplex and the mixture was heated at 90° C. for 2 min and was allowed to cool down over the course of several hours. The mixtures were then stored at 4° C. for 2 hrs. Absorbance at 254 nm was recorded at an interval of 0.5 min starting the temperature gradient from 15° C. to 90° C. with rise of 0.5° C./minute, using a Perkin Elmer UV-spectrophotometer equipped with a Peltier unit. The 254 nm absorbance was plotted against the temperature and the Tm values were calculated from the respective first derivative of each curve.

Figure 3:
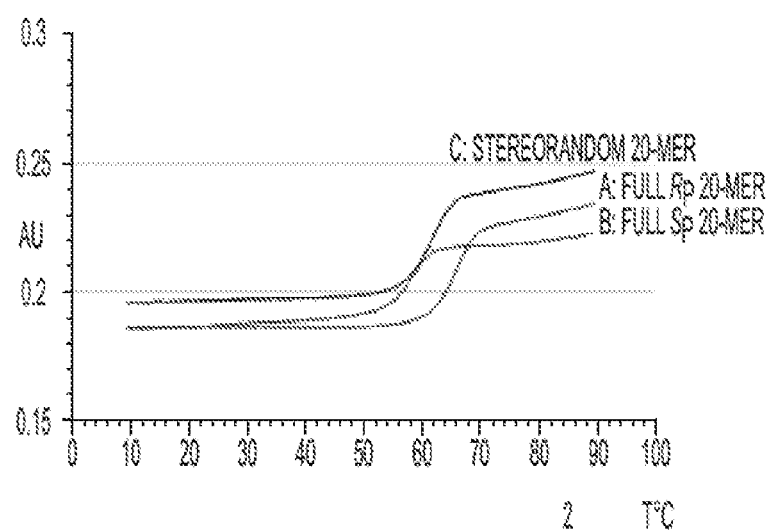
FIG. 3. Tm of chirally controlled oligonucleotides and stereorandom oligonucleotide.

FIG. 3 illustrates the difference in Tm between two stereopure diastereoisomer phosphorothioate oligonucleotides (full $R_P$ 20-mer A and full $S_P$ 20-mer B) and the stereorandom phosphorothioate oligonucleotide (C). Full $R_P$ phosphorothioate DNA demonstrate higher affinity towards complementary RNA when compared to both the opposite full $S_P$ diastereoisomer and the stereorandom 20-mer.

Table E-15 below summarizes the differences between chirally controlled oligonucleotides and stereorandom oligonucleotide.

TABLE E-15

Differences between chirally controlled and stereorandom oligonucleotides.

| Oligonucleotide | RT-IEX (min) | Tm (° C.) ±0.5 | IC$_{50}$ (nM) (rounded up to single digit) |
|---|---|---|---|
| 101 | 14.70 | 68.3 | 4 |
| 102 | 15.49 | 60.5 | 6 |
| 103 | 15.10 | 63.4 | 6 |
| 104 | 15.04 | 63.5 | 4 |
| 105 | 14.75 | 66.5 | 3 |
| 106 | 15.43 | 61.8 | 4 |
| 107 | 15.02 | 64.5 | 4 |
| 108 | 15.10 | 64.8 | 3 |
| 109 | 14.91 | 65.8 | 2 |
| 110 | 15.24 | 62.9 | 7 |
| 111 | 15.69 | NA | NA |
| 113 | 15.72 | NA | NA |
| 114 | 14.14 | 65.2 | 5 |
| 115 | 14.30 | 65.2 | 3 |
| 116 | 14.17 | 64.8 | 2 |
| 118 | 15.04 | 64.5 | 3 |
| 119 | 6.90 | 73.4 | Not detected |
| 120 | 15.49 | 65.3 | 4 |

Example 50. Biological Activity of Chirally Pure Oligonucleotides

After checking OD all oligonucleotide candidate molecules were diluted to a starting concentration of 20 µM. Multidose forward transfection experiment was setup in 96-well plates using Hep3B cells (ATCC®, Cat.HB-8064™) using Lipofectamine 2000 (Life Technologies, Cat. 11668-019) transfection reagent.

Transfection Protocol:

$2 \times 10^4$ Hep3B cells per well were seeded and incubated for 24 hours at 37° C. in a $CO_2$ incubator in 100 µl of antibiotic free MEM medium (Life Technologies, Cat.11095098) containing 10% FBS and 1% Glutamax I (Life Technologies, Cat.35050061). Twelve dilutions were setup in nuclease free water (Table E-16).

TABLE E-16

Concentrations of oligonucleotide transfection stock plate.

| | Dilution | | | | | |
|---|---|---|---|---|---|---|
| | 1 | 2 | 3 | 4 | 5 | 6 |
| In µM | 20 | 10 | 3.33333 | 1.11111 | 0.37037 | 0.12346 |

| | Dilution | | | | | |
|---|---|---|---|---|---|---|
| | 7 | 8 | 9 | 10 | 11 | 12 |
| In µM | 0.04115 | 0.01372 | 0.00457 | 0.00152 | 0.00051 | 0.00017 |

For each well, 0.5 µL of Lipofectamine 2000 were mixed with 9.5 µL of Opti MEM I reduced serum medium (Life Technologies, Cat. 31985062) and incubated for 5 minutes. Following incubation, 10 µL of each of the candidates at the reported concentrations was mixed with the diluted Lipofectamine 2000 by gentle pipetting. The mixture was then incubated for 20 minutes at room temperature to allow for complex formation. During this time the cell growth medium was replaced with 80 µL of fresh antibiotic free MEM as previously described. 20 µL of lipid-oligo complex was gently mixed into each well bringing the total volume to 100 µL. The cells were then incubated for 24 hours at 37° C. in a $CO_2$ incubator.

RNA Extraction:

After 24 hour incubation the cell growth medium was removed and RNA was extracted using a Dynabeads mRNA Direct kit (Life Technologies, Cat. 61012) per the instructions provided in the kit manual without modifications. This magnetic Oligo (dT)$^{25}$ bead system allows for cost-effective and robust high-throughput poly (A) RNA extraction circumventing DNAse treatment. RNA was eluted in nuclease-free water and stored at −80° C.

cDNA Synthesis:

10 µL of RNA was used in a 20 µL cDNA synthesis reaction using a High Capacity cDNA Reverse Transcription Kit (Life Technologies, Cat. 4374967) using the kit protocol with RNAse Inhibitor. The reverse transcription was performed in a 96-well format on a C1000 Touch thermal cycler (Biorad, Cat. 185-1196EDU).

Gene Expression Analysis:

Gene expression was measured by quantitative PCR using a LightCycler® 480 SYBR Green I Master (Roche, Cat. 04707516001) on LightCycler 480 Real-Time PCR instrument. Primers for the *Homo Sapiens* sequences of the target Apolipoprotein B (Apo B) (NM_000384) and endogenous control Glyceraldehyde-3-phosphate dehydrogenase (GAPDH) (NM_002046) were designed and ordered from IDT (Table E-17).

TABLE E-17

Sequences of HPLC purified primers used for gene expression quantification.

| Primer Name | Target | Sequence | SEQ ID NO: | Position |
|---|---|---|---|---|
| Apo B Forward primer | H. sapiens Apo B | AGCCTTGGTGGATACCCTGA AGTT | 116 | 3209-3232 |
| Apo B Reverse primer | H. sapiens Apo B | TGGACAAGGTCATACTCTGC CGAT | 117 | 3289-3312 |

TABLE E-17-continued

Sequences of HPLC purified primers used for gene expression quantification.

| Primer Name | Target | Sequence | SEQ ID NO: | Position |
|---|---|---|---|---|
| GAPDH Forward primer | H. sapiens GAPDH | CTCTGCTCCTCCTGTTCGAC | 118 | 30-49 |
| GAPDH Reverse primer | H. sapiens GAPDH | ACGACCAAATCCGTTGACTC | 119 | 122-141 |

Measurement of the target and endogenous control was performed in separate wells using material from the same cDNA template. SYBR green assay PCR conditions were setup as described in the SYBR Green 1 Master protocol (Table E-18).

TABLE E-18

Real-time PCR conditions for SYBR green assay.

| Step | Number of Cycles |
|---|---|
| Pre-incubation | 1 |
| Amplification | 45 |
| Melting curve | 1 |
| Cooling | 1 |

| Degrees °C. | Time | Acquisition Mode | Ramp rate °C./s | Acquisition per °C. |
|---|---|---|---|---|
| Pre-incubation | | | | |
| 95 | 5 min | None | 4.4 | None |
| Amplification | | | | |
| 95 | 10 sec | None | 4.4 | None |
| 60 | 10 sec | None | 2.2 | None |
| 72 | 10 sec | Single | 4.4 | None |
| Melting Curve | | | | |
| 95 | 5 sec | None | 4.4 | None |
| 65 | 1 min | None | 2.2 | None |
| 97 | | Continuous | 0.11 | 5 |
| Cooling | | | | |
| 40 | 30 sec | None | 2.2 | None |

Figure 4:
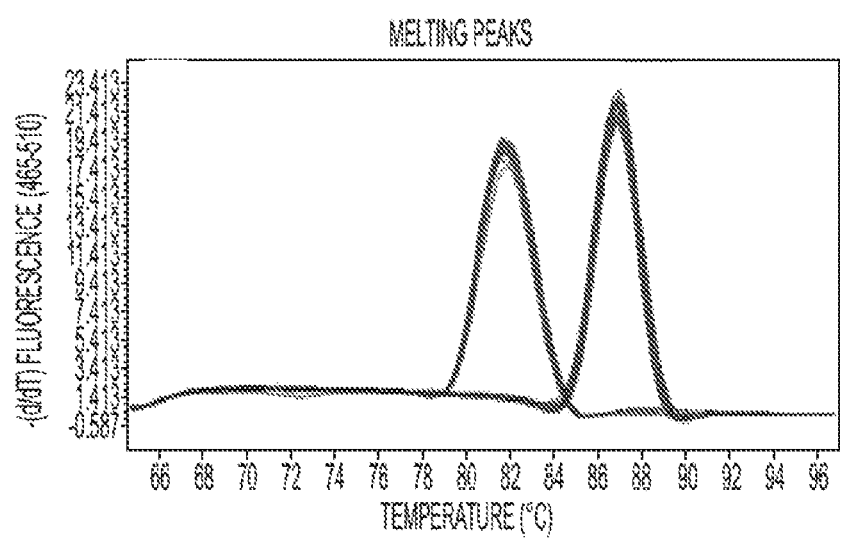
FIG. 4. Representative Data: Melting Curve Analysis of the target and endogenous control pairs yield single amplicons.

Melt Curve Analysis show single amplicon peaks for each primer pair (FIG. 4).

Figure 5:
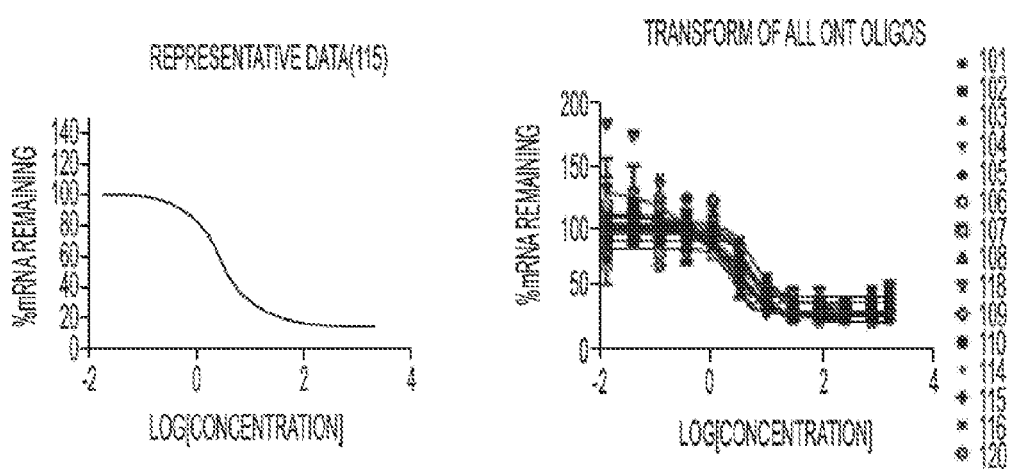
FIG. 5. Representative data and $IC_{50}$ curves for compounds.
Figure 6:
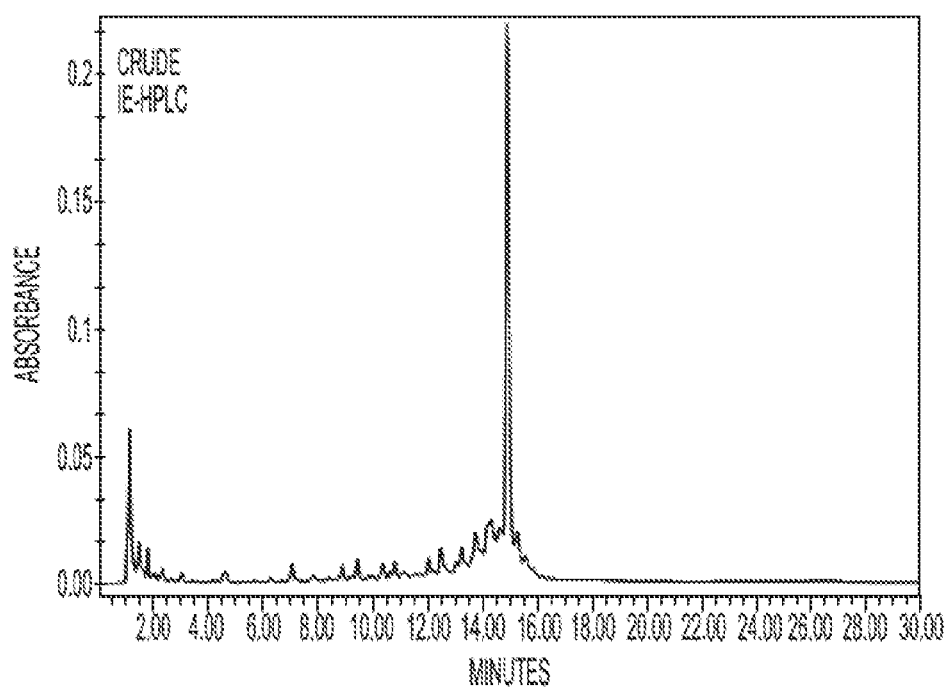
FIG. 6. HPLC of crude (Rp, Rp, Sp, Rp, Rp, Sp, Rp, Rp, Sp, Rp, Rp, Sp, Rp, Rp, Sp, Rp, Rp, Sp, Rp)-d[GsCsCsTsCsAsGsTsCsTsGsCsTsTsCsGsCsAsCsC] ((RRS)$_6$—R (SEQ ID NO: 106), stereoblockmer and P-modification unimer (s-unimer)).
Figure 7:
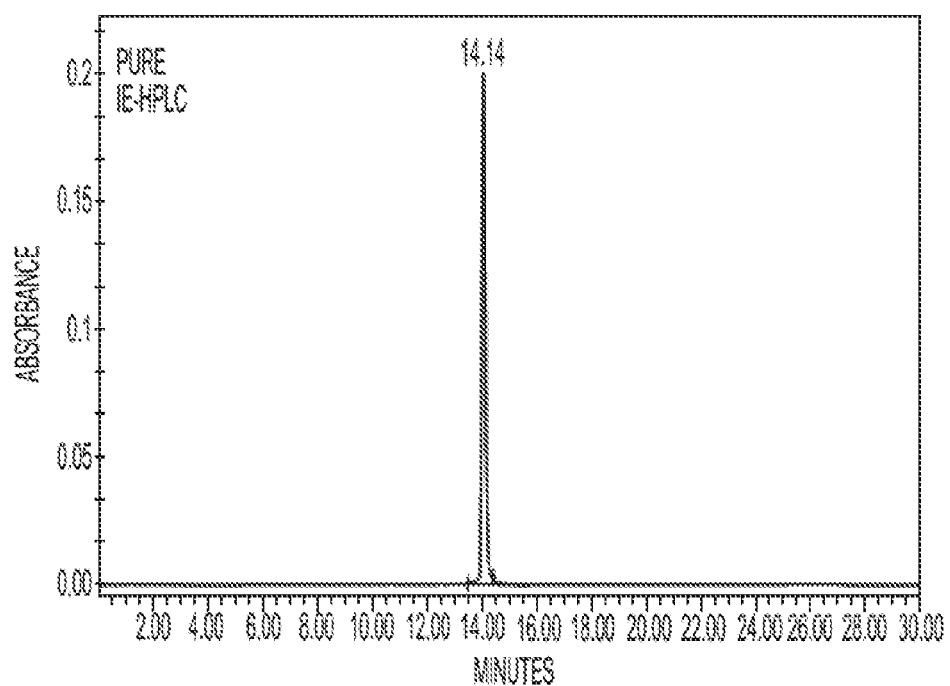
FIG. 7. HPLC of purified (Rp, Rp, Sp, Rp, Rp, Sp, Rp, Rp, Sp, Rp, Rp, Sp, Rp, Rp, Sp, Rp, Rp, Sp, Rp)-d[GsCsCsTsCsAsGsTsCsTsGsCsTsTsCsGsCsAsCsC] ((RRS)$_6$—R (SEQ ID NO: 106), stereoblockmer and P-modification unimer (s-unimer)).
Figure 8:
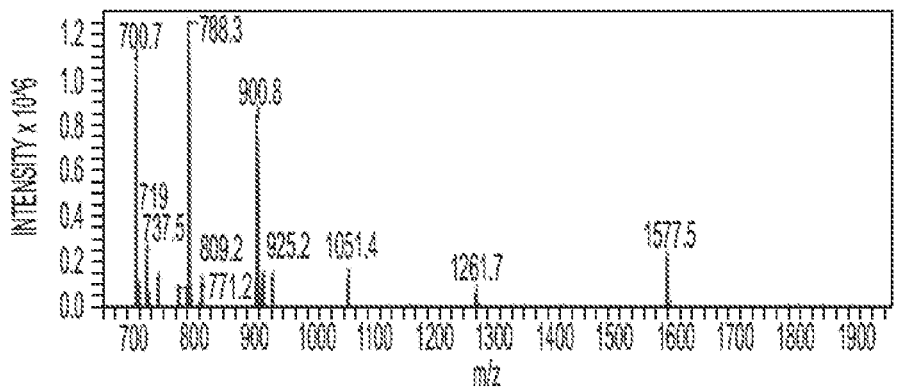
FIG. 8. LCMS of (Rp, Rp, Sp, Rp, Rp, Sp, Rp, Rp, Sp, Rp, Rp, Sp, Rp, Rp, Sp, Rp, Rp, Sp, Rp)-d[GsCsCsTsCsAsGsTsCsTsGsCsTsTsCsGsCsAsCsC] ((RRS)$_6$—R (SEQ ID NO: 106), stereoblockmer and P-modification unimer (s-unimer)).
Figure 8:
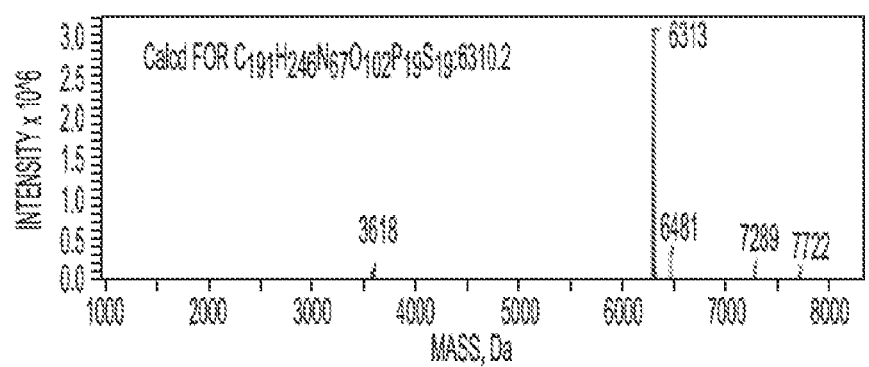
Figure 9:
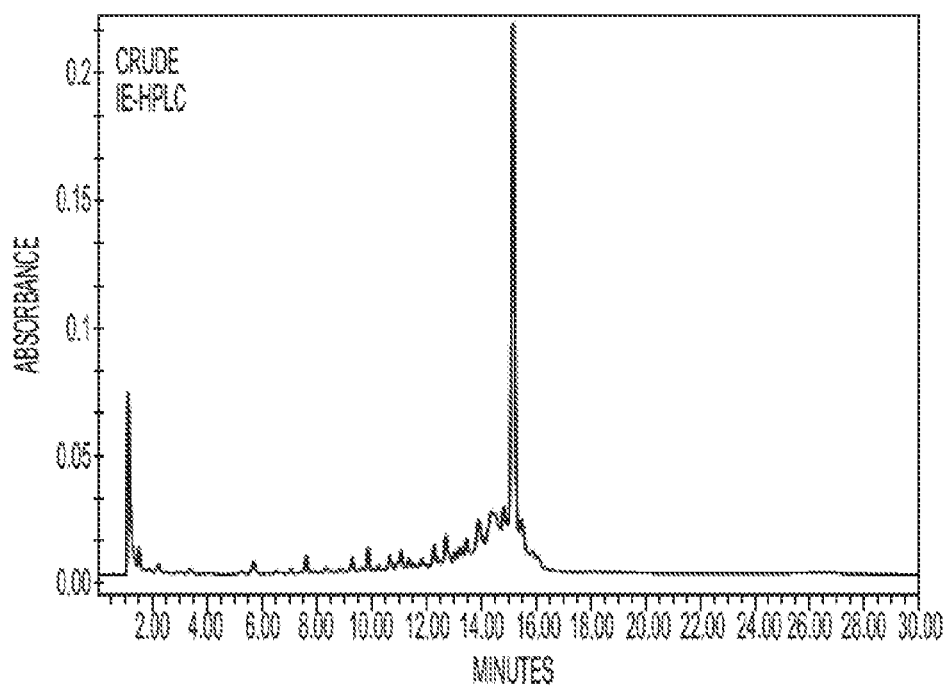
FIG. 9. HPLC of crude (Sp, Rp, Rp, Sp, Rp, Rp, Sp, Rp, Rp, Sp, Rp, Rp, Sp, Rp, Rp, Sp, Rp, Rp, Sp)-d[GsCsCsTsCsAsGsTsCsTsGsCsTsTsCsGsCsAsCsC] (S—(RRS)$_6$ (SEQ ID NO: 106), stereoblockmer and P-modification unimer (s-unimer)).
Figure 10:
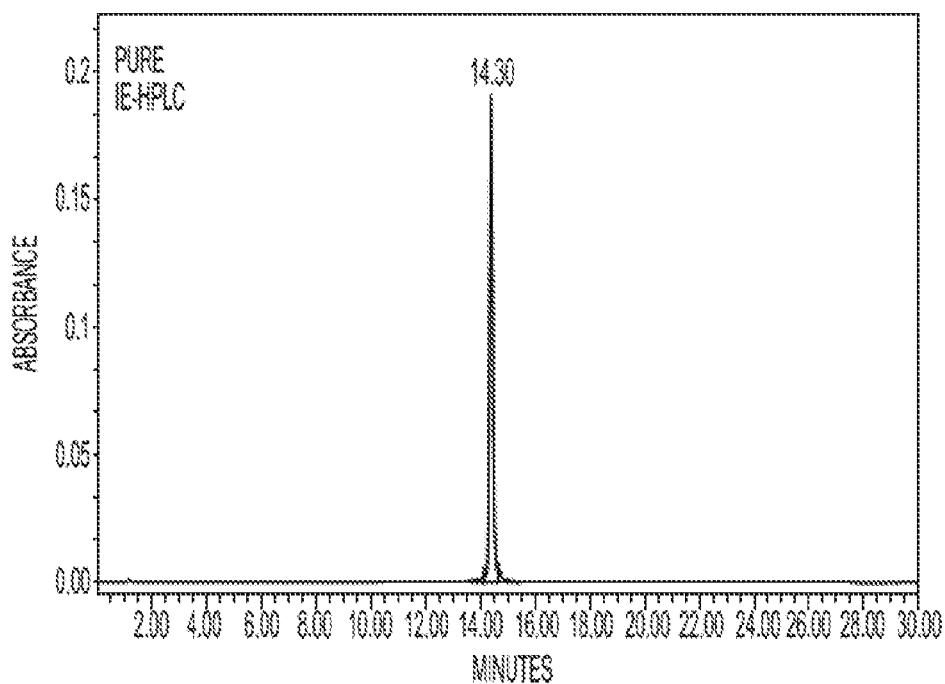
FIG. 10. HPLC of purified (Sp, Rp, Rp, Sp, Rp, Rp, Sp, Rp, Rp, Sp, Rp, Rp, Sp, Rp, Rp, Sp, Rp, Rp, Sp)-d[GsCsCsTsCsAsGsTsCsTsGsCsTsTsCsGsCsAsCsC] (S—(RRS)$_6$ (SE ID NO: 106), stereoblockmer and P-modification unimer (s-unimer)).
Figure 11:
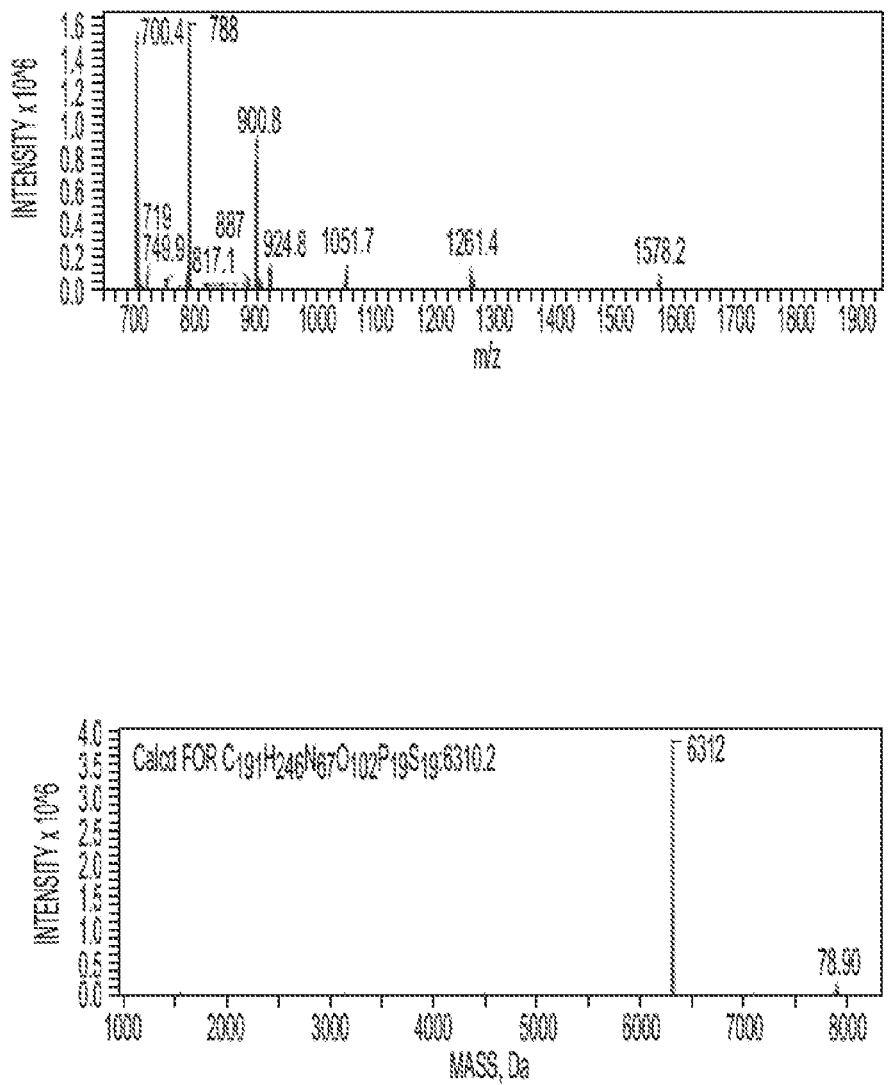
FIG. 11. LCMS of (Sp, Rp, Rp, Sp, Rp, Rp, Sp, Rp, Rp, Sp, Rp, Rp, Sp, Rp, Rp, Sp, Rp, Rp, Sp)-d[GsCsCsTsCsAsGsTsCsTsGsCsTsTsCsGsCsAsCsC] (S—(RRS)$_6$ (SEQ ID NO: 106), stereoblockmer and P-modification unimer (s-unimer)).
Figure 12:
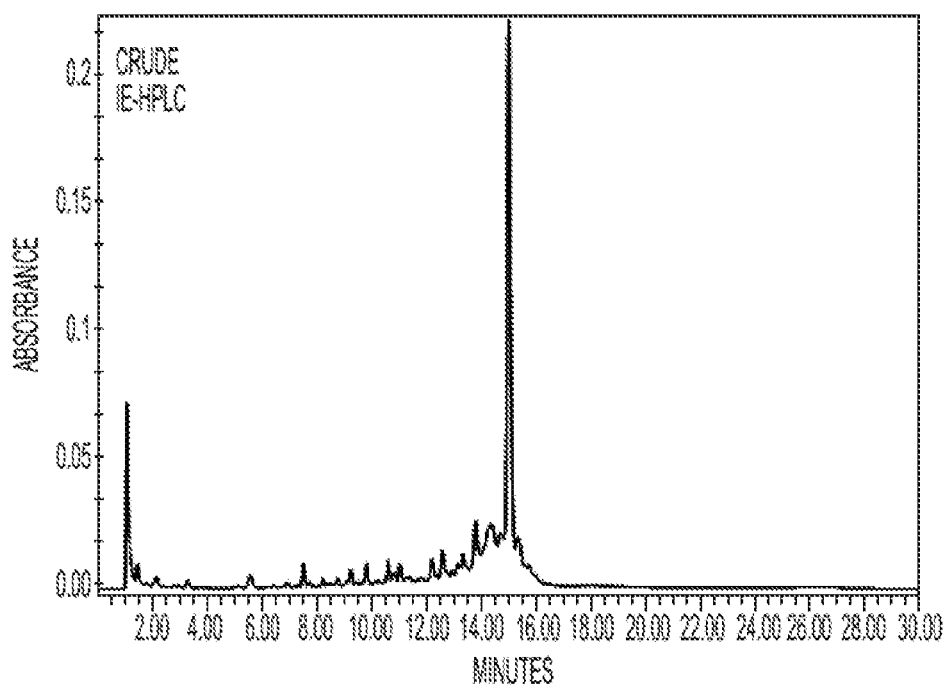
FIG. 12. HPLC of crude (Rp, Sp, Rp, Rp, Sp, Rp, Rp, Sp, Rp, Rp, Sp, Rp, Rp, Sp, Rp, Rp, Sp, Rp, Rp) d[GsCsCsTsCsAsGsTsCsTsGsCsTsTsCsGsCsAsCsC] (RS—(RRS)$_5$—RR (SEQ ID NO: 106), stereoblockmer and P-modification unimer (s-unimer)).
Figure 13:
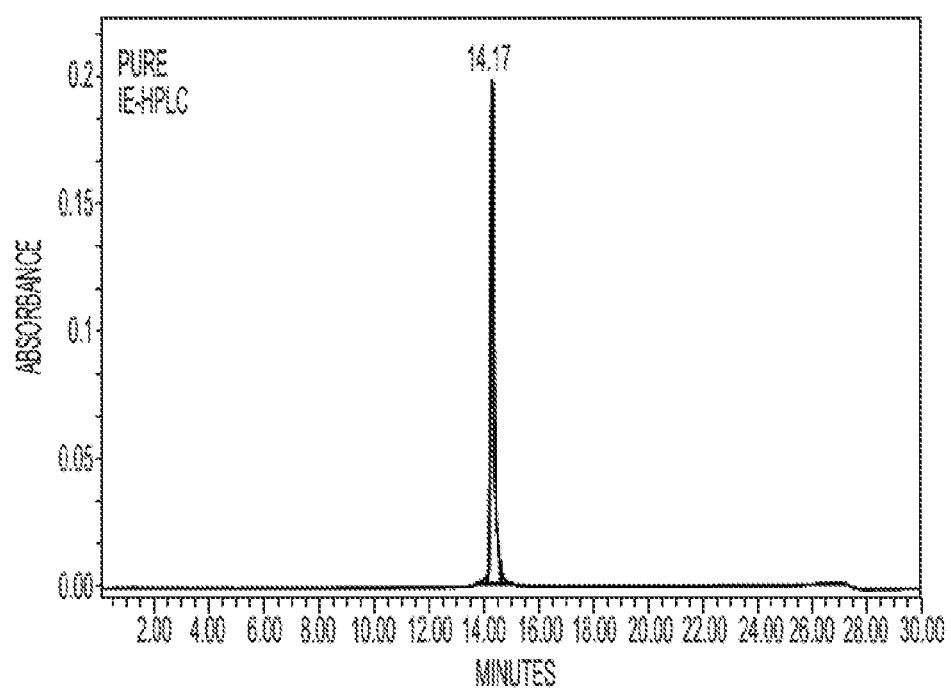
FIG. 13. HPLC of purified (Rp, Sp, Rp, Rp, Sp, Rp, Rp, Sp, Rp, Rp, Sp, Rp, Rp, Sp, Rp, Rp, Sp, Rp, Rp) d[GsCsCsTsCsAsGsTsCsTsGsCsTsTsCsGsCsAsCsC] (RS—(RRS)$_5$—RR (SEQ ID NO: 106), stereoblockmer and P-modification unimer (s-unimer)).
Figure 14:
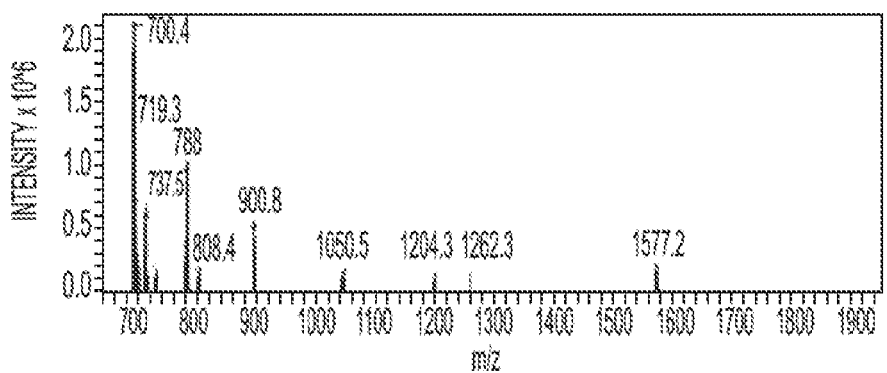
FIG. 14. LCMS of (Rp, Sp, Rp, Rp, Sp, Rp, Rp, Sp, Rp, Rp, Sp, Rp, Rp, Sp, Rp, Rp, Sp, Rp, Rp)-d[GsCsCsTsCsAsGsTsCsTsGsCsTsTsCsGsCsAsCsC] (RS—(RRS)$_5$—RR (SEQ ID NO: 106), stereoblockmer and P-modification unimer (s-unimer)).
Figure 14:
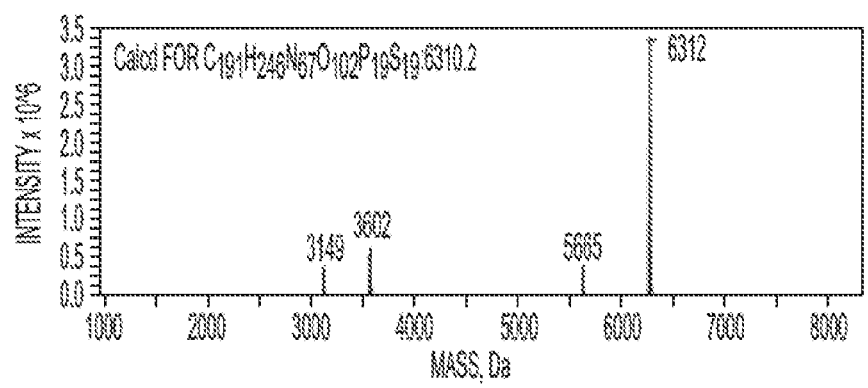
Figure 15:
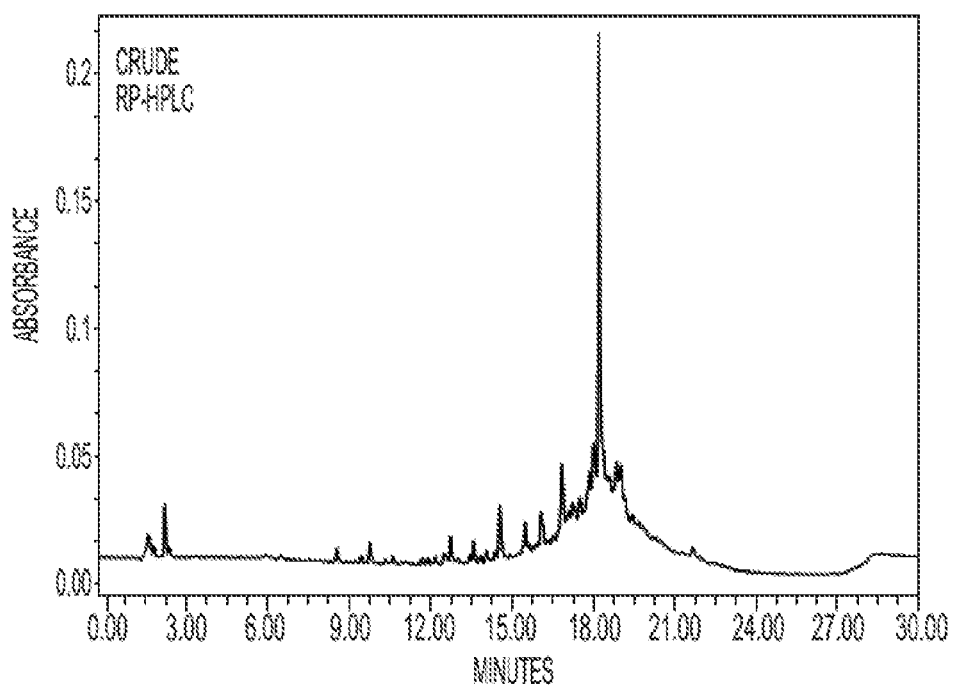
FIG. 15. HPLC of crude (Rp, Rp, Rp, Sp, Sp, Sp, Sp, Sp, Rp, Rp, Rp)-d[5mCs1As1Gs1Ts15mCs1Ts1Gs15mCs1Ts1Ts15mCs1G] (SEQ ID NO: 108) (3R-5S-3R, stereoblockmer and P-modification unimer (s1-unimer)).
Figure 16:
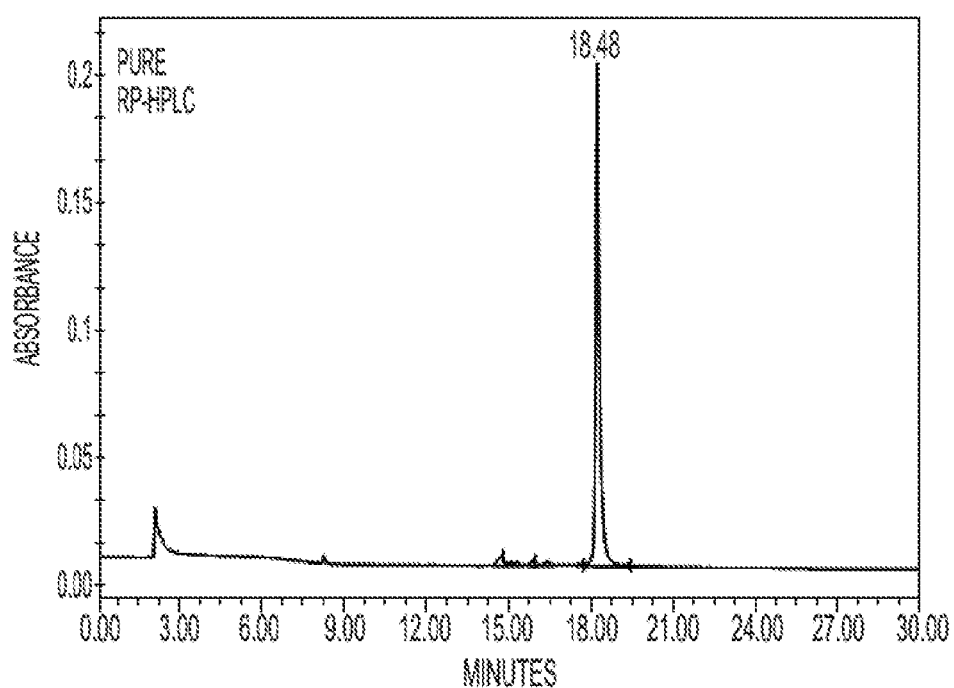
FIG. 16. HPLC of purified (Rp, Rp, Rp, Sp, Sp, Sp, Sp, Sp, Rp, Rp, Rp)-d[5mCs1As1Gs1Ts15mCs1Ts1Gs15mCs1s1Ts15mCs1G] (SEQ ID NO: 108) (3R-5S-3R, stereoblockmer and P-modification unimer (s1-unimer)).
Figure 17:
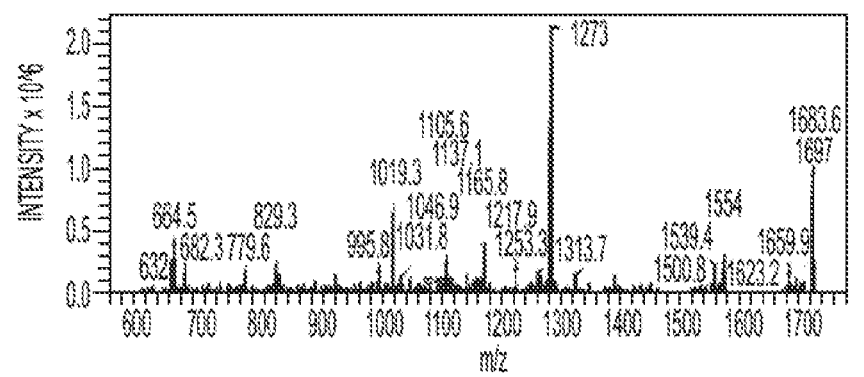
FIG. 17. LCMS of (Rp, Rp, Rp, Sp, Sp, Sp, Sp, Sp, Rp, Rp, Rp)-d[5mCs1As1Gs1Ts15mCs1Ts1Gs15mCs1Ts1Ts15mCs1G] (SEQ ID NO: 108) (3R-5S-3R, stereoblockmer and P-modification unimer (s1-unimer)).
Figure 17:
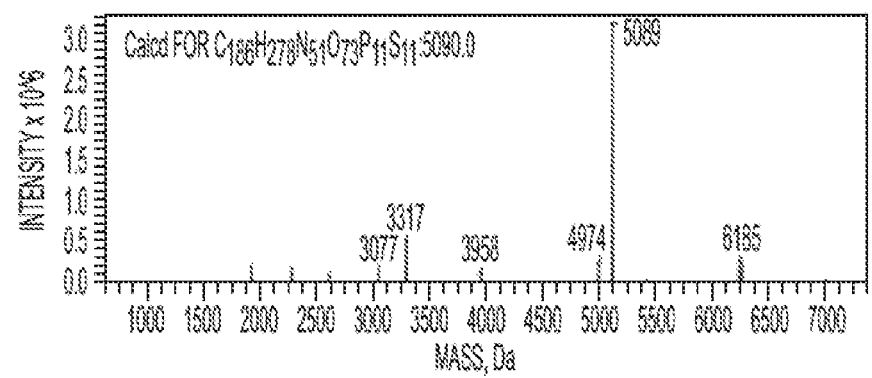
Figure 18:
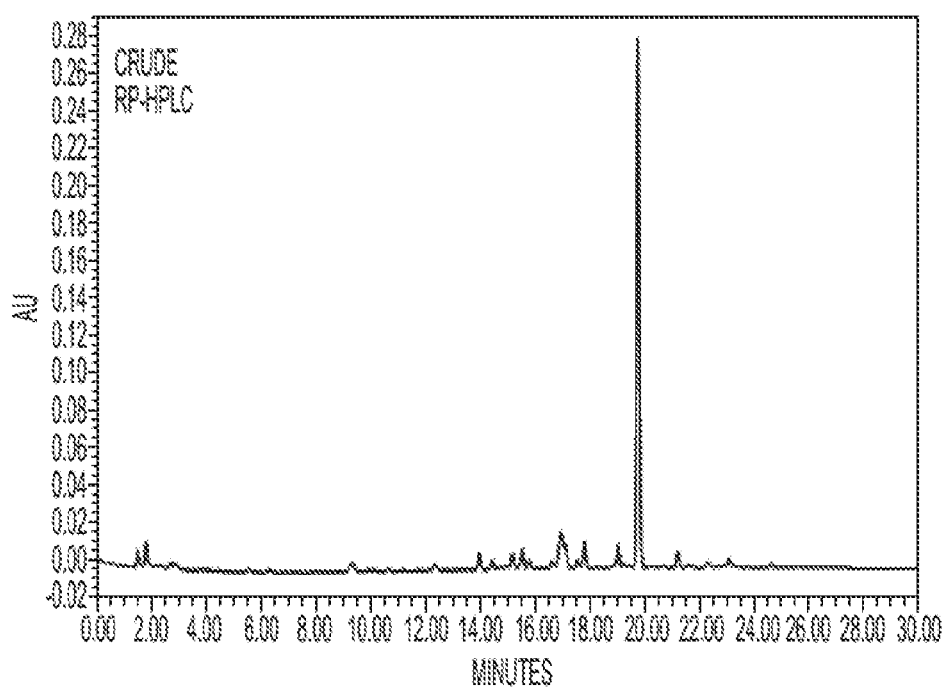
FIG. 18. HPLC of crude All-(Rp)-d[Cs3As3Gs3T] (P-modification unimer (s3-unimer), stereounimer and linkage unimer).
Figure 19:
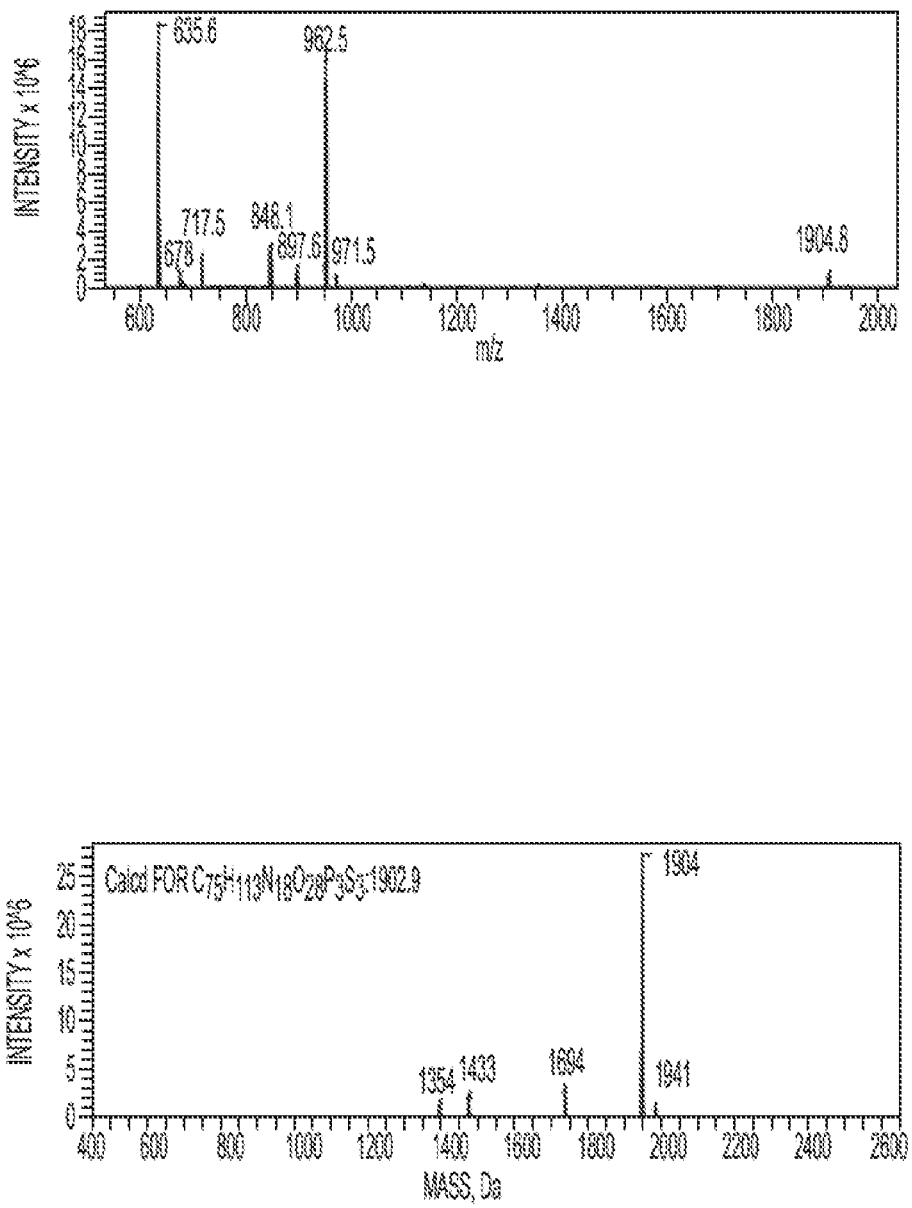
FIG. 19. LCMS of All-(Rp)-d[Cs3As3Gs3T] (P-modification unimer (s3-unimer), stereounimer and linkage unimer).
Figure 20:
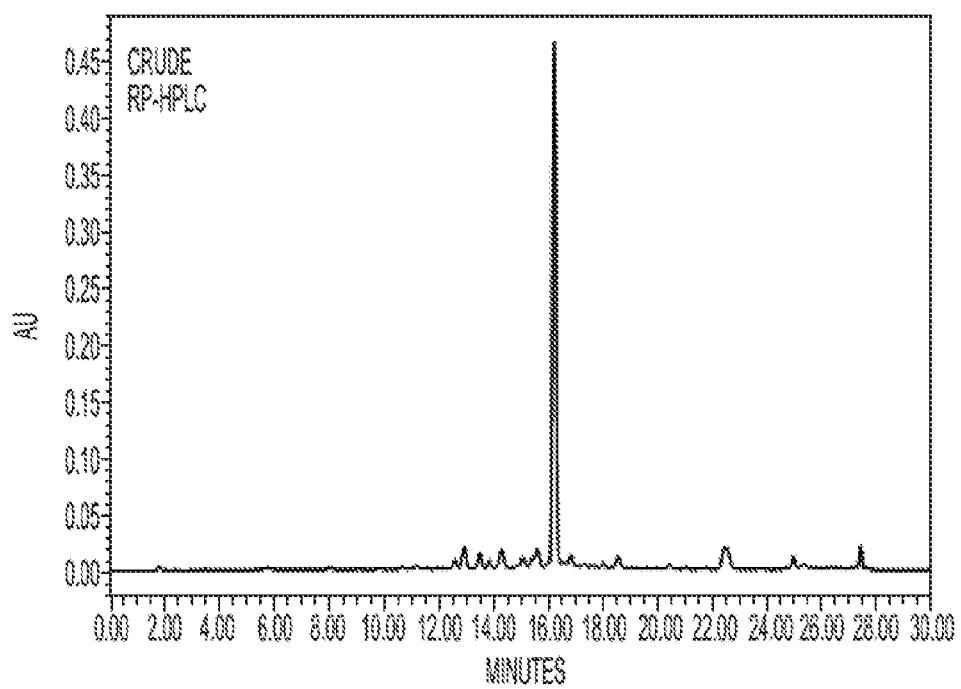
FIG. 20. HPLC of crude All-(Rp)-d[Cs2As2Gs2T] (P-modification unimer (s2-unimer), stereounimer and linkage unimer).
Figure 21:
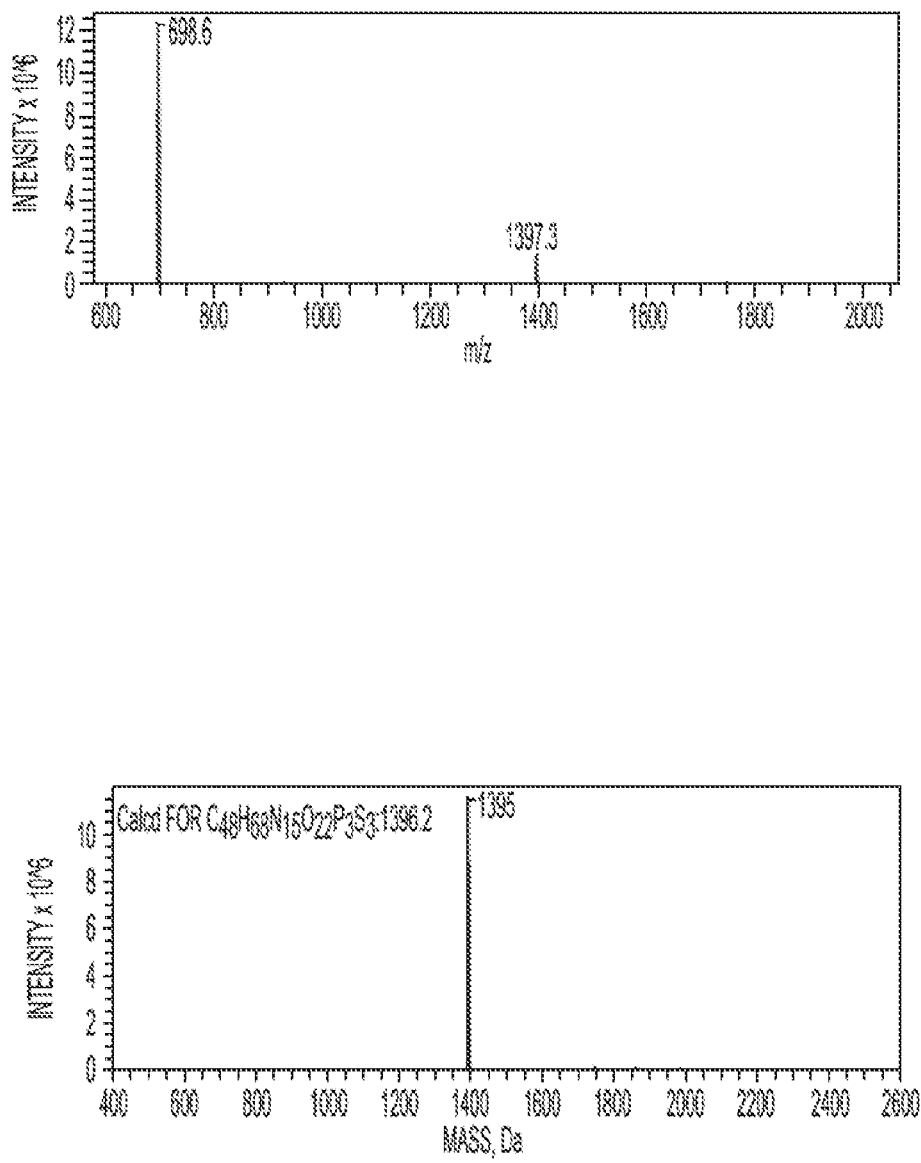
FIG. 21. LCMS of All-(Rp)-d[Cs2As2Gs2T] (P-modification unimer (s2-unimer), stereounimer and linkage unimer).
Figure 22:
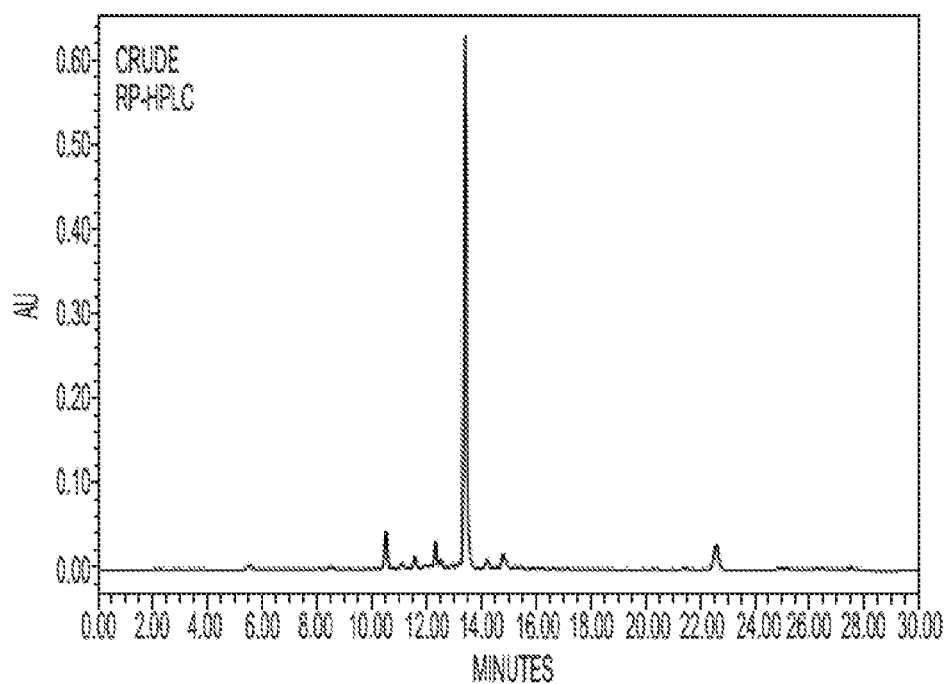
FIG. 22. HPLC of crude All-(Sp)-d[Cs1AGs1T] (gapmer, stereoaltmer, P-modification altmer and linkage altmer).
Figure 23:
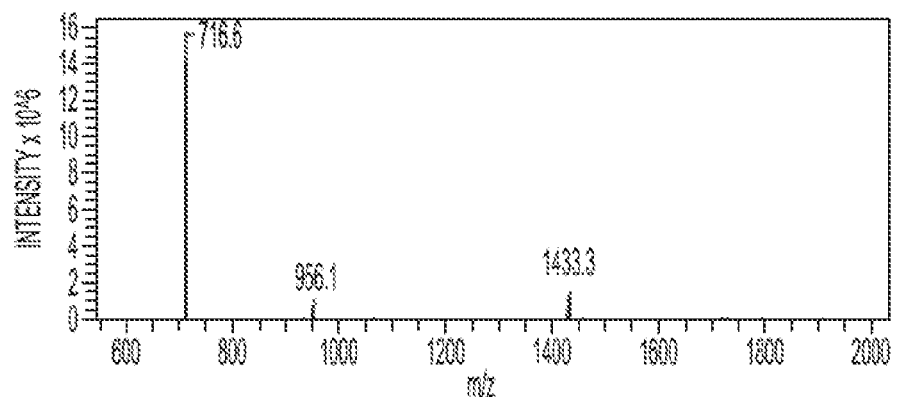
FIG. 23. LCMS of All-(Sp)-d[Cs1AGs1T] (gapmer stereoaltmer, P-modification altmer and linkage altmer).
Figure 23:
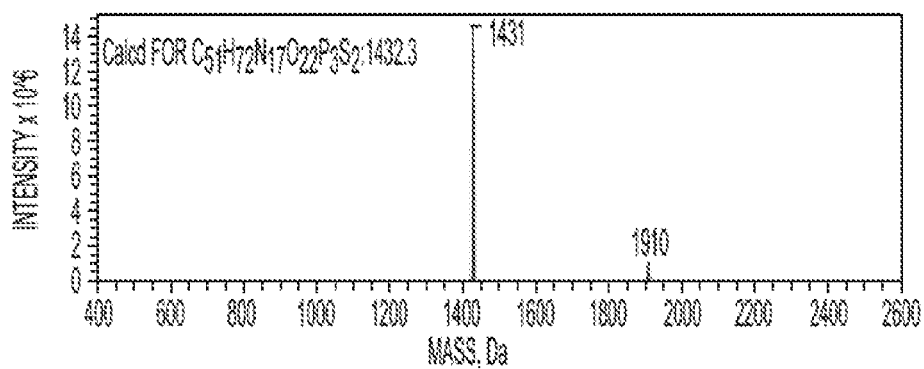
Figure 24:
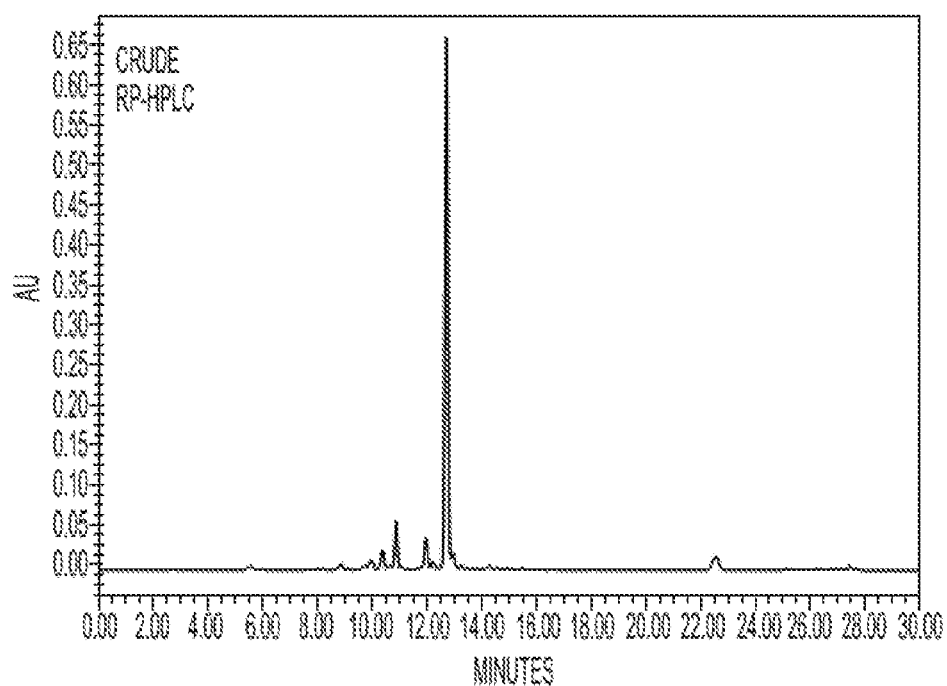
FIG. 24. Crude All-(Rp)-d[TsCs1AsT] (stereounimer, P-modification altmer and linkage altmer).
Figure 25:
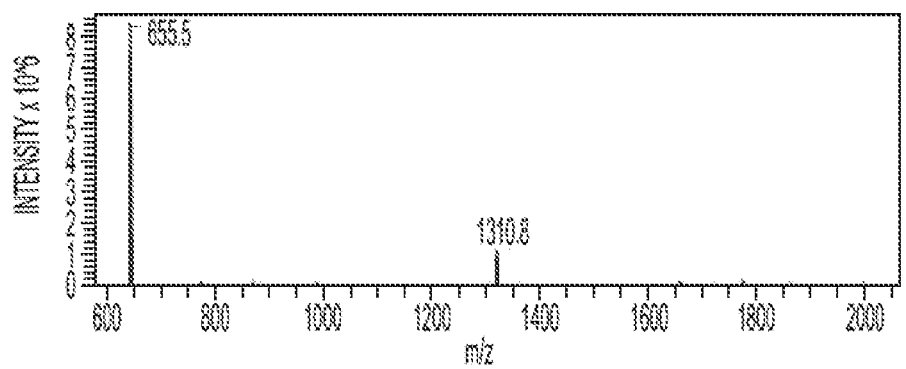
FIG. 25. LCMS of All-(Rp)-d[TsCs1AsT] (stereounimer, P-modification altmer and linkage altmer).
Figure 25:
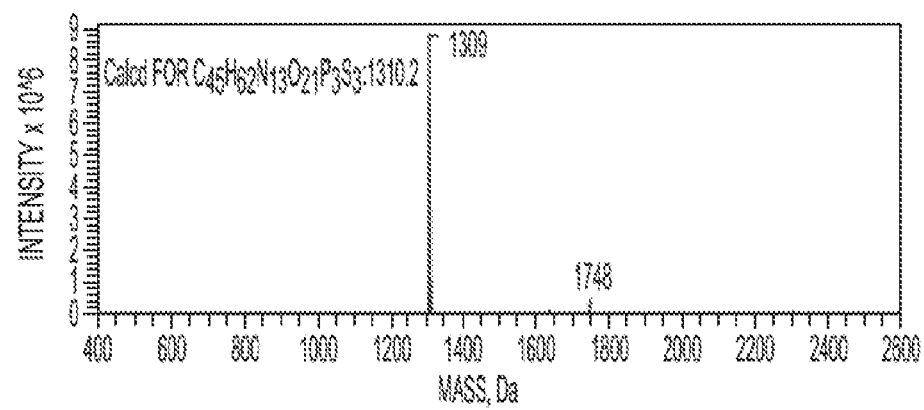
Figure 26:
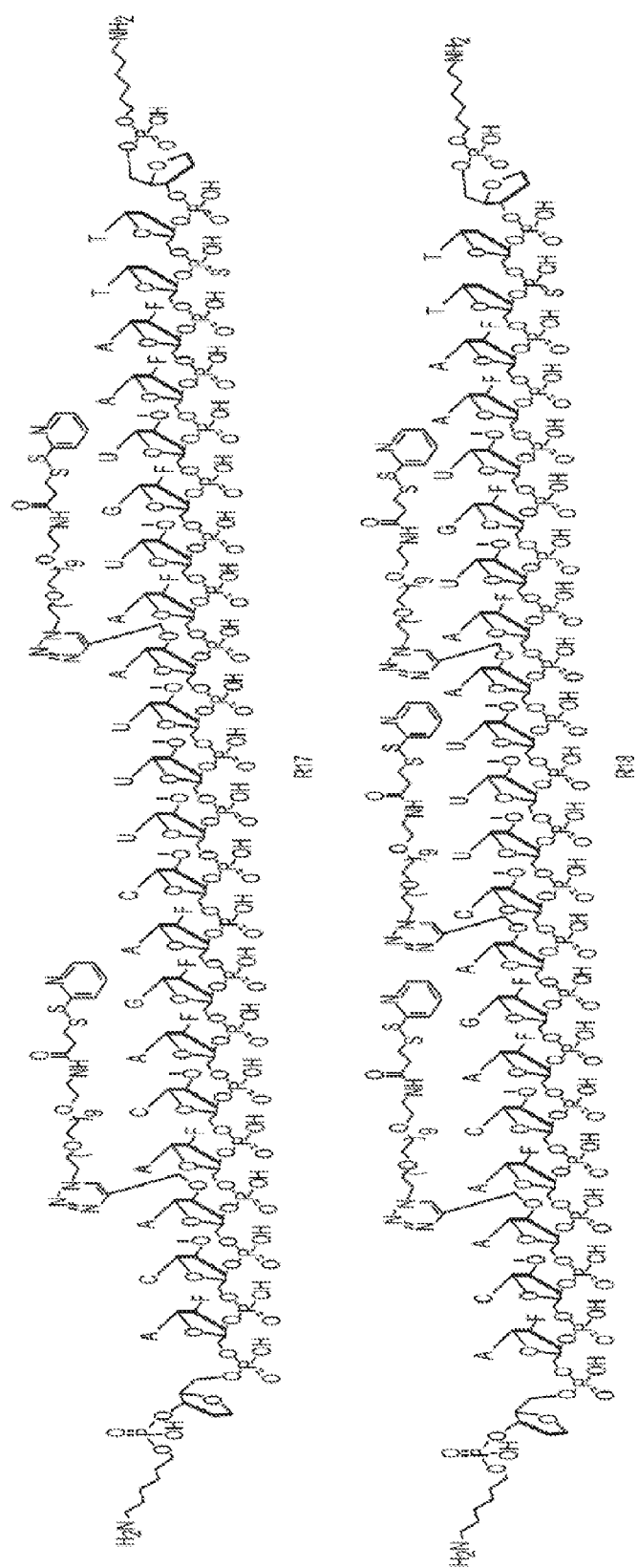
FIG. 26. Exemplary oligonucleotides (SEQ ID NOS 133 and 133, respectively, in order of appearance) described in WO2012/030683 and contemplated for synthesis using methods of the present invention.
Figure 27:
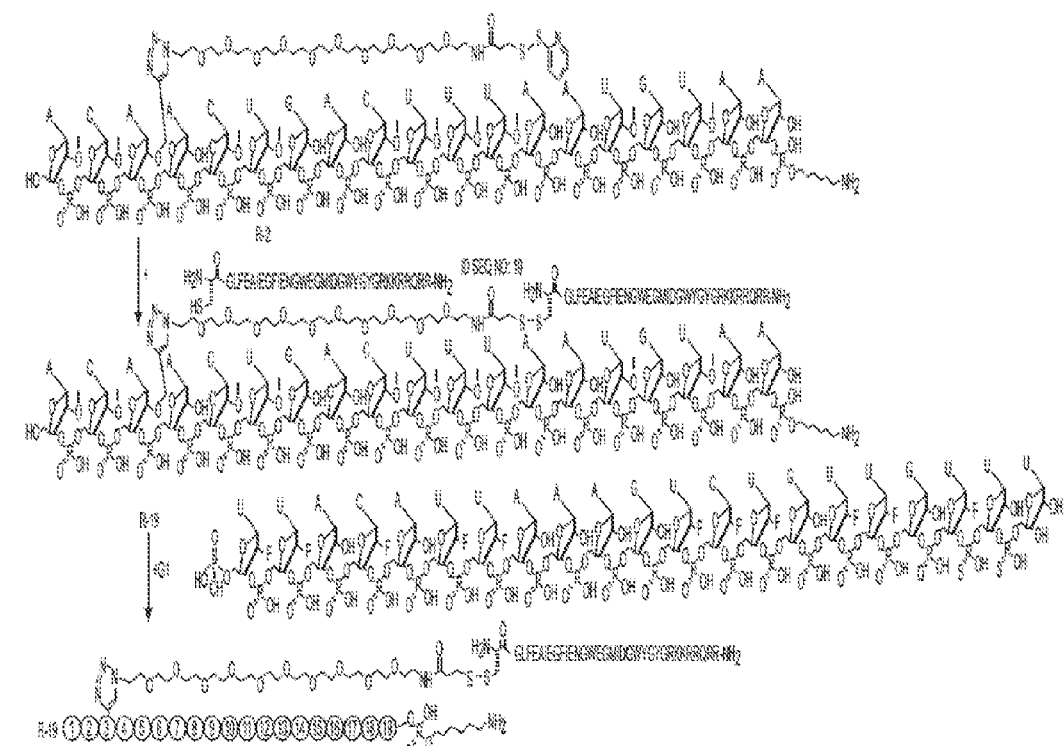
FIG. 27. Exemplary oligonucleotides (SEQ ID NOS 134-135, 135, 134, 136 and 135, respectively, in order of appearance) described in WO2012/030683 and contemplated for synthesis using methods of the present invention.
Figure 28:
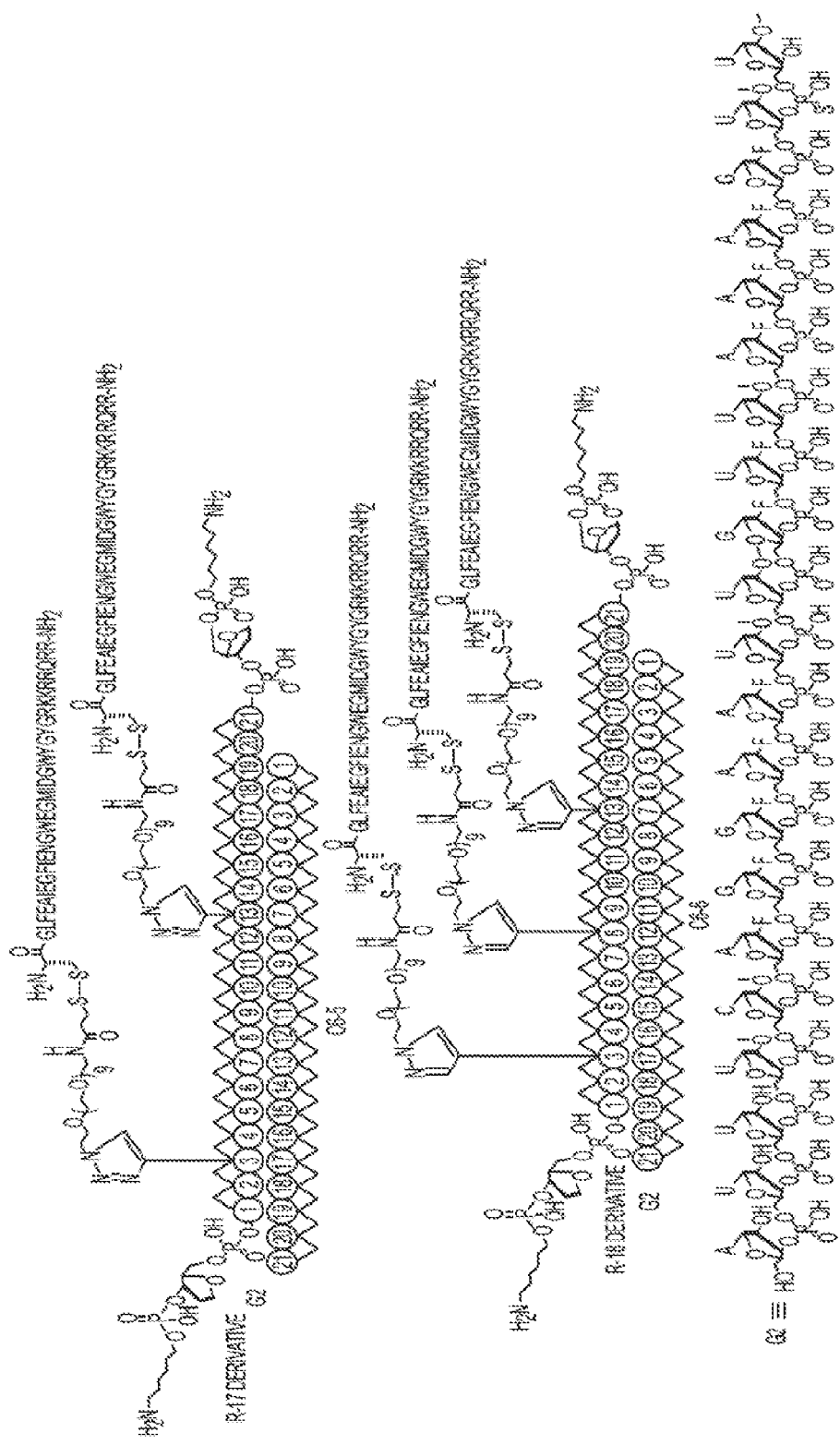
FIG. 28. Exemplary oligonucleotides (SEQ ID NOS 135, 135, 135, 135, 135 and 137, respectively, in order of appearance) described in WO2012/030683 and contemplated for synthesis using methods of the present invention.
Figure 29:
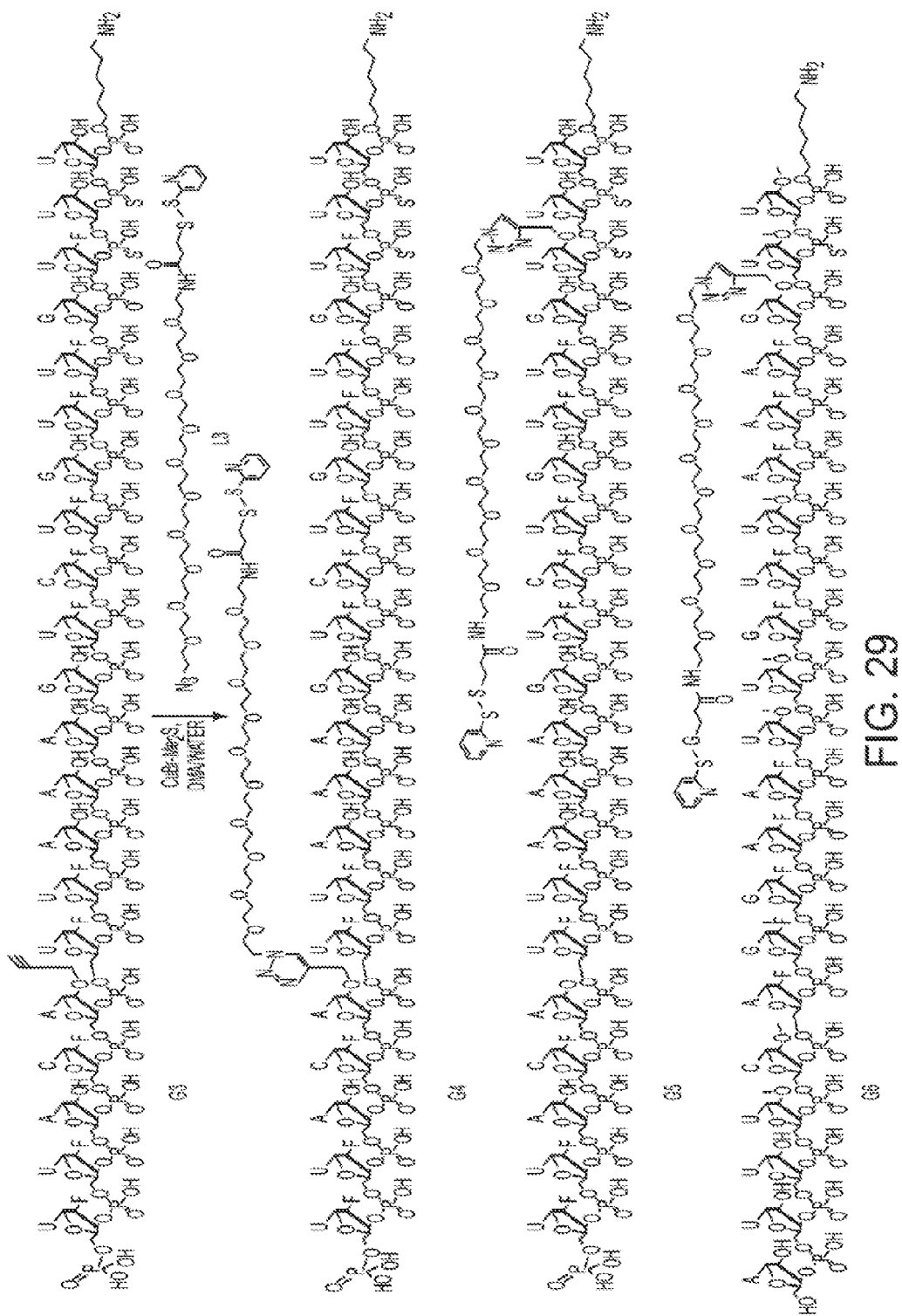
FIG. 29. Exemplary oligonucleotides (SEQ ID NOS 136, 138, 136 and 137, respectively, in order of appearance) described in WO2012/030683 and contemplated for synthesis using methods of the present invention.
Figure 30:
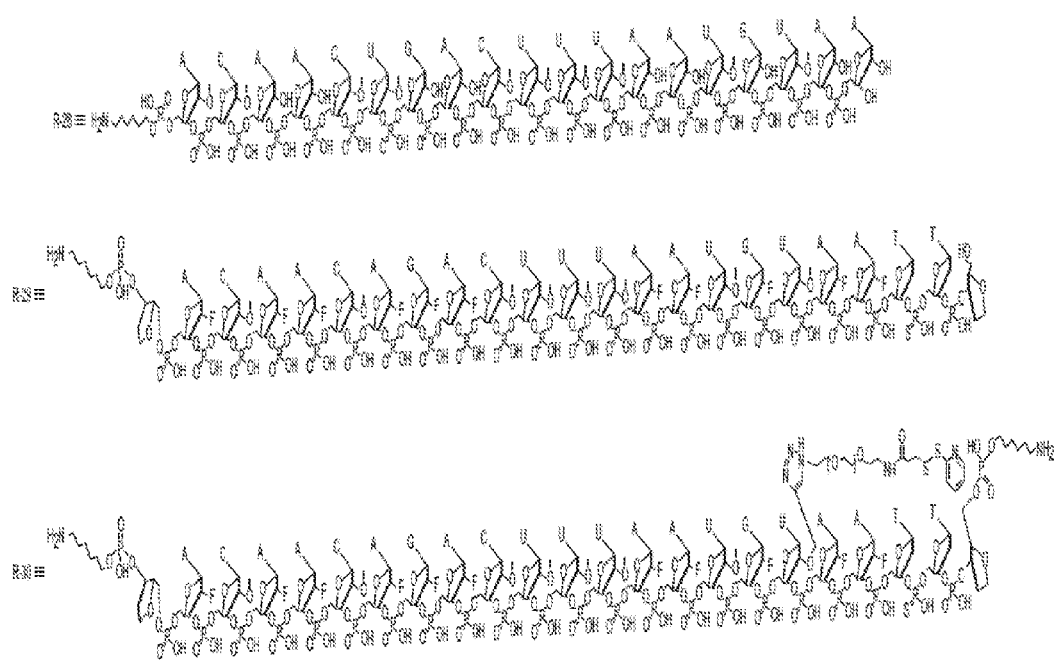
FIG. 30. Exemplary oligonucleotides (SEQ ID NOS 134, 133 and 133, respectively, in order of appearance) described in WO2012/030683 and contemplated for synthesis using methods of the present invention.
Figure 31:
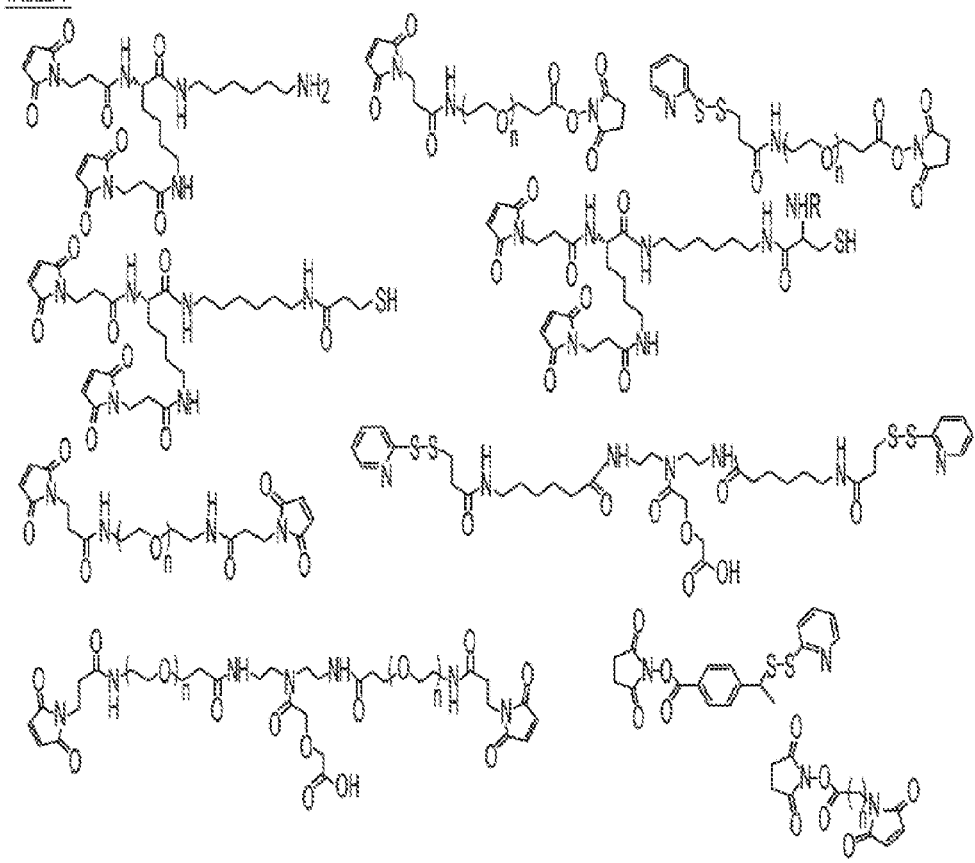
FIG. 31. Exemplary linkers described in WO2012/030683 for use in methods of the present invention.
Figure 32:
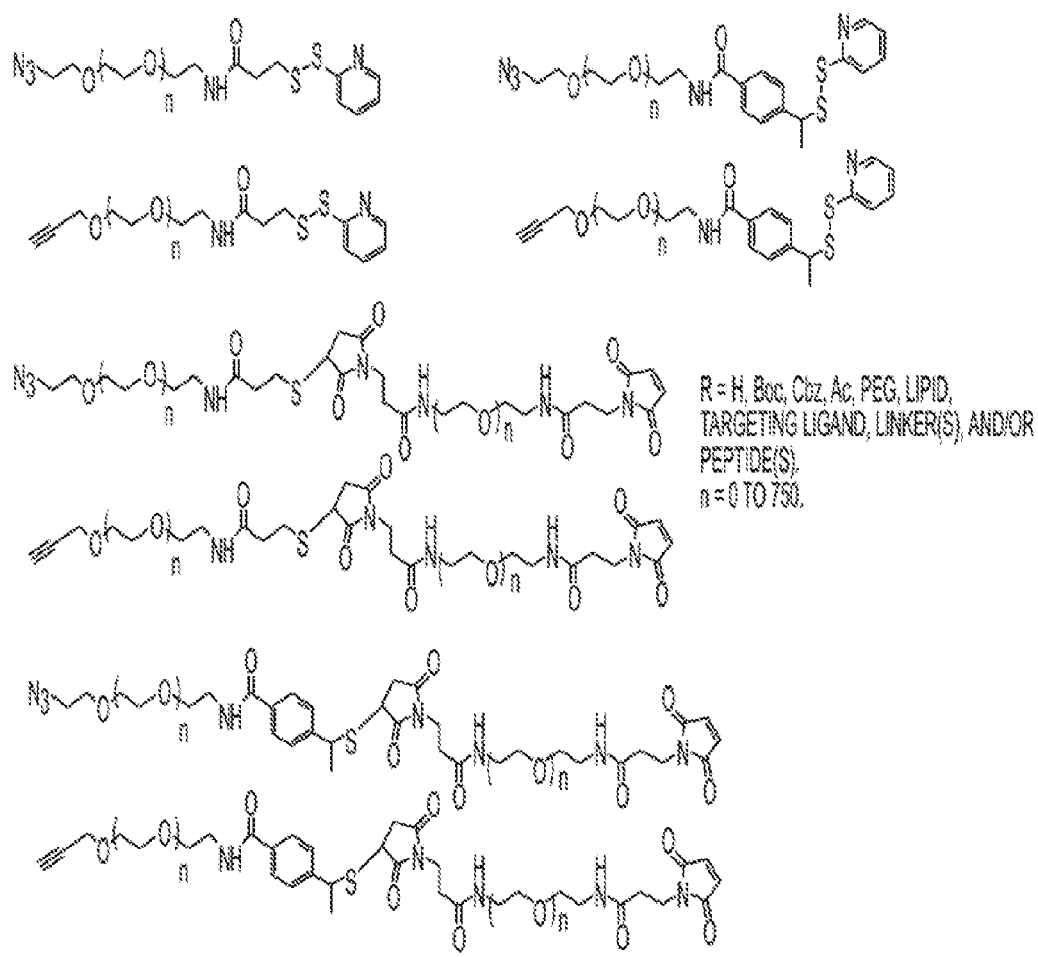
FIG. 32. Exemplary linkers described in WO2012/030683 for use in methods of the present invention.
Figure 33:
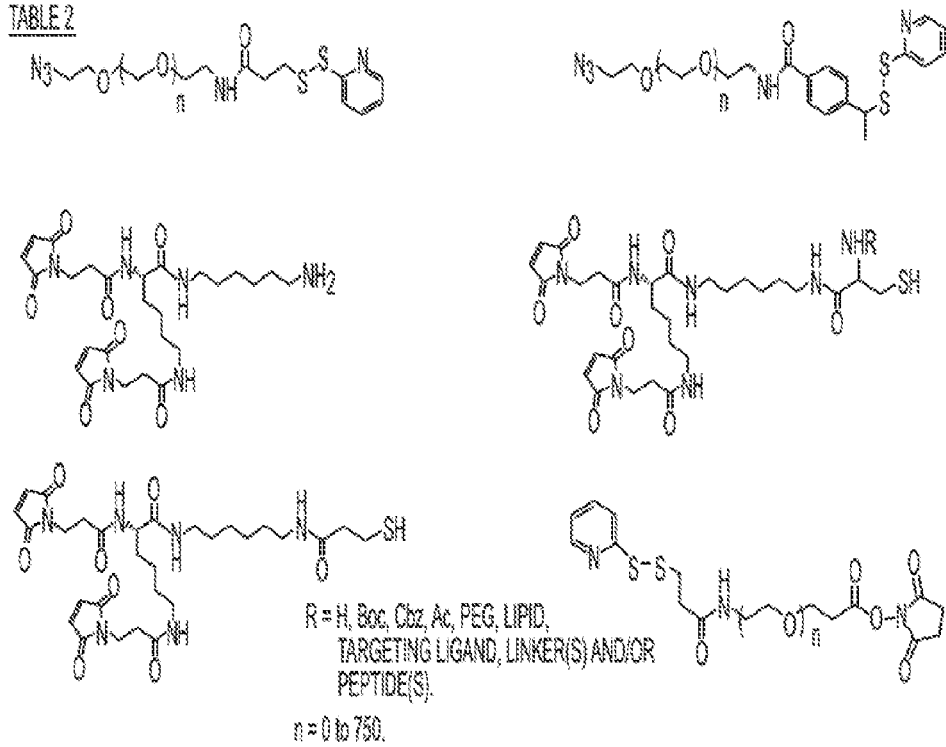
FIG. 33. Exemplary linkers described in WO2012/030683 for use in methods of the present invention.
Figure 34:
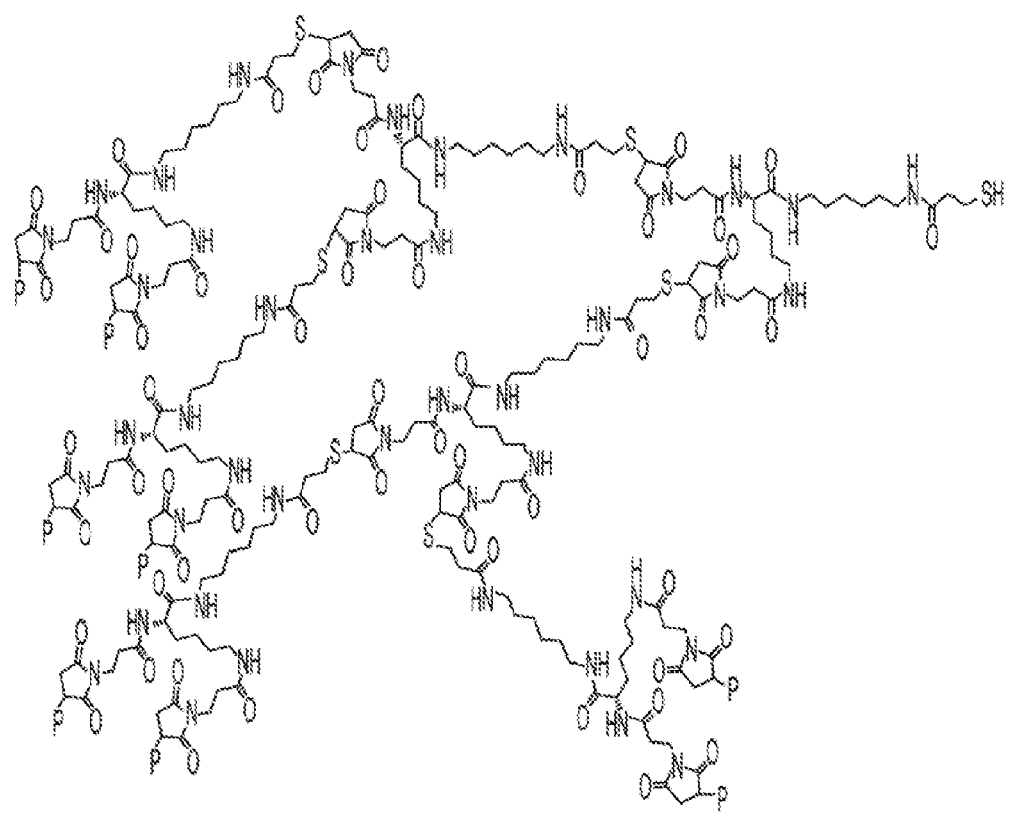
FIG. 34. Exemplary linkers described in WO2012/030683 for use in methods of the present invention.

The data is a result of 3 biological replicates. All samples were compared to Naïve untransfected control. The following results were observed when evaluating gene expression by real-time PCR using SYBR green (Table E-19, FIG. 5).

TABLE E-19

Complete $IC_{50}$ data evaluated by SYBR green.

| Oligonucleotide | $IC_{50}$ (nM) |
|---|---|
| 101 All-R | 4.368 |
| 102 All-S | 6.345 |
| 103 5R-9S-5R | 5.727 |
| 104 5S-9R-5S | 4.291 |
| 105 1S-17R-1S | 2.877 |

TABLE E-19-continued

Complete $IC_{50}$ data evaluated by SYBR green.

| Oligonucleotide | $IC_{50}$ (nM) |
|---|---|
| 106 1R-17S-1R | ~3.855 |
| 107 (R/S)$_9$R | ~4.180 |
| 108 (S/R)$_9$S | 3.189 |
| 118 Stereorandom | 3.087 |
| 109 3S-13R-3S | 1.722 |
| 110 3R-13S-3R | 7.437 |
| 114 3R-13S-3R | 5.234 |
| 115 S-(RRS)$_6$ | 2.689 |
| 116 RS-(RRS)$_5$-RR | 1.919 |
| 120 Mipomersen | 4.386 |

In some embodiments, provided chirally controlled oligonucleotides show an $IC_{50}$ below 8 nM. In some embodiments, provided chirally controlled oligonucleotides show an $IC_{50}$ below 7 nM. In some embodiments, provided chirally controlled oligonucleotides show an $IC_{50}$ below 6 nM. In some embodiments, provided chirally controlled oligonucleotides show an $IC_{50}$ below 5 nM. In some embodiments, provided chirally controlled oligonucleotides show an $IC_{50}$ below 4 nM. In some embodiments, provided chirally controlled oligonucleotides show an $IC_{50}$ below 3 nM. In some embodiments, provided chirally controlled oligonucleotides show an $IC_{50}$ below 2 nM. In some embodiments, provided chirally controlled oligonucleotides show an $IC_{50}$ within a range of 0.5-8 nM. In some embodiments, provided chirally controlled oligonucleotides show an $IC_{50}$ within a range of 1-4 nM. In some embodiments, provided chirally controlled oligonucleotides show an $IC_{50}$ within a range of 1.5-3 nM. In some embodiments, provided chirally controlled oligonucleotides show an $IC_{50}$ within a range of 1.5-2 nM. In some embodiments, provided chirally controlled oligonucleotides show an $IC_{50}$ within a range of 0.5-2 nM. In some embodiments, provided chirally controlled oligonucleotides show an $IC_{50}$ within a range of 1-2.5 nM. In some embodiments, provided chirally controlled oligonucleotides show an $IC_{50}$ within a range of 1.5-3 nM. In some embodiments, provided chirally controlled oligonucleotides show an $IC_{50}$ within a range of 2.5-5 nM. In some embodiments, provided chirally controlled oligonucleotides show an $IC_{50}$ within a range of 3-6 nM. In some embodiments, provided chirally controlled oligonucleotides show an $IC_{50}$ within a range of 5-8 nM. In some embodiments, provided chirally controlled oligonucleotides show an $IC_{50}$ within a range between an upper boundary and a lower boundary. In some such embodiments, the upper boundary is 8, 5, 4, or 3 nM. In some such embodiments, the lower boundary is 1, 1.5, 2, or 2.5 nM. As can be seen with reference to the Examples, the present disclosure specifically exemplifies various chirally controlled oligonucleotides or chirally controlled oligonucleotide compositions showing representative such $IC_{50}$ values.

Table E-19 illustrates that when test in chirally controlled form, certain chirally controlled oligonucleotides/oligonucleotide compositions are more potent than the corresponding stereorandom oligonucleotide mixture (Oligonucleotides 105, 109, 115 and 116 compared to Oligonucleotide 118); they are also more active than Mipomersen, which is a stereorandom oligonucleotide mixture (Oligonucleotides 104, 105, 106, 107, 109, 115 and 116 compared to 120).

Additional Chirally Controlled Preparations

Example 51. Preparation of Chirally Controlled Preparations of Oligonucleotides

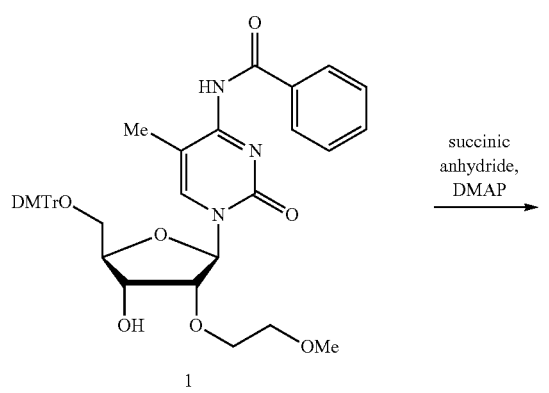

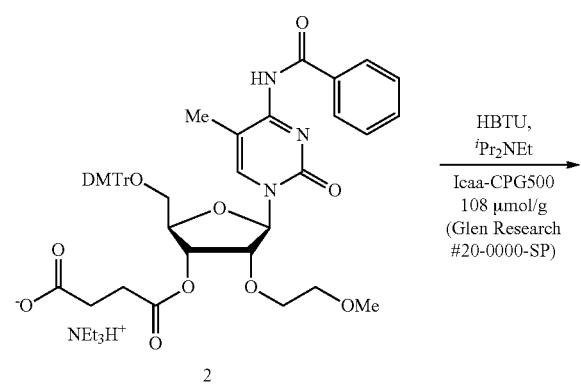

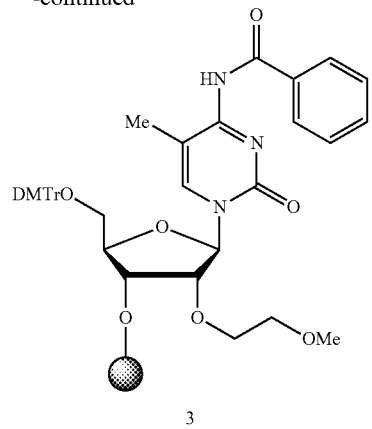

The present Example describes preparation of a variety of particular chirally controlled composition of certain oligonucleotides as described herein. In particular, the present Example describes oligonucleotide preparation on utilizing loaded lcaa-CPG-500.

$N^4$-Bz-5'-O-DMTr-2'-O-MOE-5mC (1) (4.0 g, 5.5 mmol) was dissolved in anhydrous DCM (20 mL) and mixed with 2 equiv of succinic anhydride (1.1 g, 11.1 mmol) and 3 equiv of 4-N,N-dimethylaminopyridine (2.0 g, 16.6 mmol). The reaction was stirred under Argon at room temperature. After complete consumption of the starting material as determined by TLC (1 hour), the solvents were evaporated to dryness, the crude residue was dissolved in DCM containing 1% triethylamine then purified by flash silica gel chromatography using a gradient of 0-2% of MeOH in DCM containing 2% triethylamine. Yield of pure compound (2) after evaporation was 4.5 g, 88%. The resulting 3'-O-succinate (2) (0.92 g, 1.0 mmol), N,N-diisopropylethylamine (0.82 ml, 5.0 mmol) and CPG-500 (10 g) were taken up in DMF (50 mL) then HBTU (0.42 g, 1.1 mmol) was added. The mixture was shaken for 2 h then filtered. The support was washed with DMF, MeOH and finally, DCM then dried in vacuo. Trityl cation analysis (monitoring at 504 nm) showed that the loading of the nucleoside on the support (3) was 63 µmol/g.

Chirally controlled compositions of oligonucleotides containing stereodefined chimeric deoxy and 2'-O-MOE phosphorothioate triester internucleotidic linkages was synthesized on MerMade-12 DNA/RNA synthesizer (BioAutomation) according to the cycle summarized in Table E-20 using a MM-6-200 synthesis column (BioAutomation) loaded with 2.0 g (126 µmol) of uncapped succinyl linked $N^4$-Bz-5'-O-DMTr-2'-O-MOE-5mC (63 µmol/g, lcaa CPG-500 from Glen Research. The oligonucleotide synthesis cycle was performed with a preliminary capping step (capping 2) and without removal of the final terminal 5'-O-DMTr oligonucleotide group (DMT On). The stereospecific sulfurization steps were performed using the 0.3 M S-(2-cyanoethyl)methylthiosulfonate reagent following the coupling of the corresponding chiral phosphoramide and the two-step capping process (Table E-20).

Once the automated oligonucleotide synthesis cycle was completed with the final 5'-O-DMTr group kept On, the synthesis column was taken off the DNA/RNA synthesizer and dried under vacuum. The dried support was transferred onto an empty glass manual peptide synthesizer and 40 mL solution of 0.5 M 1,5-diazabicyclo[4.3.0]non-5-ene (DBN), 0.25 M N,O-bis(trimethylsilyl)trifluoroacetamide (BSTFA) in ACN was continuously passed through the support for 5 min without stopping the flow in the manual peptide synthesizer. The support was washed by 50% Py/ACN and dried with Argon flow for 1 sec. Then, the support was transferred into an empty screw-cap plastic vial and treated with 5% EtOH/conc NH$_3$ (20 mL) at 60° C. for 6 h, and left at room temperature for 12 h. The support was removed by filtration and washed with conc. NH$_3$. The filtrate was dried in vacuo then the resultant was dissolved in 50 mM TEAA (120 mL). Further filtration was performed when there was a suspension in the solution. The solution was loaded on a Sep-Pak cartridge (Waters, Sep-Pak Vac 35 cc (10 g) C$_{18}$ Cartridges). The cartridge was washed with 20% ACN/50 mM TEAA (70 mL) to remove all capped truncated sequences and 50% ACN/water containing 0.5% of conc NH$_3$ (50 mL) to elute the full length DMT On oligonucleotide. The solution containing the DMT On oligonucleotide was dried in vacuo then diluted with 50 mM TEAA (120 mL) and loaded on another Sep-Pak cartridge (Waters, Sep-Pak Vac 35 cc (10 g) C$_{18}$ Cartridges). The cartridge was washed with milli Q water (50 mL), 2% TFA/water (50 mL), then water (50 mL). The DMT Off oligonucleotide was eluted with 50% ACN/water containing 0.5% of conc NH$_3$ (50 mL).

TABLE E-20

Summary for Oligonucleotide Synthesis on a DNA/RNA Synthesizer MerMade 12 Used for Chirally Controlled Synthesis.

| step | reaction | reagent | delivery volume (mL) | wait time (sec) |
|---|---|---|---|---|
| 1 | detritylation | 3% TCA in DCM | 3 × 10 | 3 × 24 |
| 2 | coupling | 0.15M chiral phosphoramidite in ACN + 1.2M CMPT in ACN | 2 × 3.4 | 2 × 450 (MOE) 2 × 300 (DNA) |
| 3 | capping 1 | 5% Pac$_2$O in THF/2,6-lutidine | 8 | 60 |
| 4 | capping 2 | 5% Pac$_2$O in THF/2,6-lutidine + 16% NMI in THF | 6.8 | 60 |
| 5 | sulfurization | 0.3M S-(2-cyanoethyl) methanethiosulfonate $$NC\diagup\diagdown S\overset{O}{\underset{O}{\overset{\|}{\underset{\|}{S}}}}Me$$ in ACN/BSTFA | 9 | 600 |

Synthesis of Oligonucleotide ONT-75 (All (Rp))-Gs5mCs5mCsTs5mCsAs GsTs5mCsTsGs5mCsTsTs5mCs Gs5mCsAs5mCs5mC (SEQ ID NO: 106)

Synthesis of Oligonucleotide ONT-80 (All (Sp))-Gs5mCs5mCsTs5mCsAs GsTs5mCsTsGs5mCsTsTs5mCs Gs5mCsAs5mCs5mC (SEQ ID NO: 106)

Synthesis of Oligonucleotide ONT-77 (Rp, Rp, Rp, Rp, Rp, Sp, Sp, Sp, Sp, Sp, Sp, Sp, Sp, Sp, Sp, Rp, Rp, Rp, Rp)-Gs5mCs5mCsTs5mCsAs GsTs5mCsTsGs5mCsTsTs5mCs Gs5mCsAs5mCs5mC (SEQ ID NO: 106) (5R-10S-4R)

Synthesis of Oligonucleotide ONT-81 (Sp, Sp, Sp, Sp, Sp, Rp, Rp, Rp, Rp, Rp, Rp, Rp, Rp, Rp, Rp, Sp, Sp, Sp, Sp)-Gs5mCs5mCsTs5mCsAs GsTs5mCsTsGs5mCsTsTs5mCs Gs5mCsAs5mCs5mC (SEQ ID NO: 106) (5S-10R-4S)

Synthesis of Oligonucleotide ONT-87 (Rp, Rp, Rp, Rp, Rp, Sp, Sp, Rp, Sp, Sp, Rp, Sp, Sp, Rp, Rp, Rp, Rp, Rp, Rp)-Gs5mCs5mCsTs5mCsAs GsTs5mCsTsGs5mCsTsTs5mCs Gs5mCsAs5mCs5mC (SEQ ID NO: 106) (5R—(SSR)$_3$-5R)

Synthesis of Oligonucleotide ONT-88 (Sp, Sp, Sp, Sp, Sp, Rp, Rp, Sp, Rp, Rp, Sp, Rp, Rp, Sp, Sp, Sp, Sp, Sp, Sp)-Gs5mCs5mCsTs5mCsAs GsTs5mCsTsGs5mCsTsTs5mCs Gs5mCsAs5mCs5mC (SEQ ID NO: 106) (5S—(RRS)$_3$-5S)

Synthesis of Oligonucleotide ONT-89 (Sp, Rp, Sp, Rp, Sp, Rp, Sp, Rp, Sp, Rp, Sp, Rp, Sp, Rp, Sp, Rp, Sp, Rp, Sp)-Gs5mCs5mCsTs5mCsAs GsTs5mCsTsGs5mCsTsTs5mCs Gs5mCsAs5mCs5mC (SEQ ID NO: 106) ((SR)$_9$S)

Synthesis of Oligonucleotide ONT-82 (All (Rp))-GsTs5mCs5mCs5mCsTsGsAsAsGsAsTsGsTs5mCs AsAsTsGs5mC (SEQ ID NO: 120)

Synthesis of Oligonucleotide ONT-84 (All (Sp))-GsTs5mCs5mCs5mCsTsGsAsAsGsAsTsGsTs5mCs AsAsTsGs5mC (SEQ ID NO: 120)

Synthesis of Oligonucleotide ONT-85 (Rp, Rp, Rp, Rp, Rp, Sp, Sp, Sp, Sp, Sp, Sp, Sp, Sp, Sp, Sp, Rp, Rp, Rp, Rp)-GsTs5mCs5mCs5mCsTsGsAsAsGsAsTsGsTs5mCs AsAsTsGs5mC (SEQ ID NO: 20) (5R-10S-4R)

Synthesis of Oligonucleotide ONT-86 (Sp, Sp, Sp, Sp, Sp, Rp, Rp, Rp, Rp, Rp, Rp, Rp, Rp, Rp, Rp, Sp, Sp, Sp, Sp)-GsTs5mCs5mCs5mCsTsGsAsAsGsAsTsGsTs5mCs AsAsTsGs5mC (SEQ ID NO: 120) (5S-10R-4S)

Example 52: General RP-HPLC Method for the Analysis of Crude DMT on and Purified DMT Off Oligonucleotides The present Example describes RP-HPLC analysis of crude and purified oligonucleotide compositions prepared by chirally controlled synthesis as described herein.

Buffer A: 50 mM TEAA, pH 7.0
Buffer B: ACN
Column: XBridge C$_{18}$, 3.5 µm, C$_{18}$, 4.6×50 mm, Part #186003034
Column temperature=50° C.
Signal monitored at 254 and 280 nm
Gradient Used:

| Time(min) | Flow (mL/min) | % A | % B | Curve |
|---|---|---|---|---|
| Initial |  | 99 | 1 |  |
| 2 | 1 | 99 | 1 | 6 |
| 52 | 1 | 50 | 50 | 6 |
| 55 | 1 | 5 | 95 | 6 |
| 55.5 | 1 | 5 | 95 | 6 |
| 56 | 1 | 99 | 1 | 6 |
| 60 | 1 | 99 | 1 | 1 |

Figure 35:
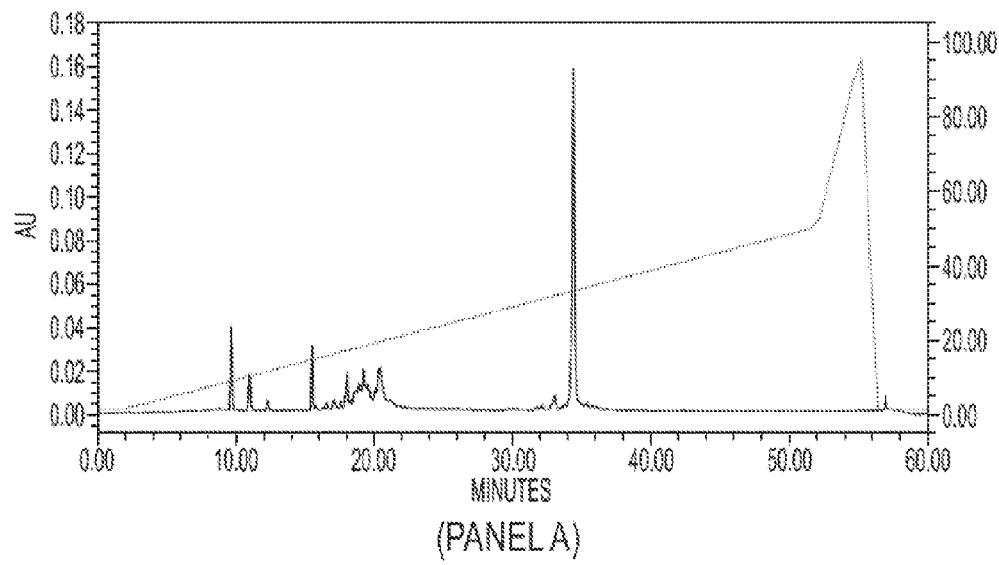
FIG. 35. RP-HPLC of crude DMT on oligonucleotide: ONT-75 (Panel A); ONT-80 (Panel B); ONT-77 (Panel C); ONT-81 (Panel D); ONT-87 (Panel E); ONT-88 (Panel F); ONT-89 (Panel G); ONT-82 (Panel H); ONT-84 (Panel I); ONT-85 (Panel J); ONT-86 (Panel K).
Figure 35:
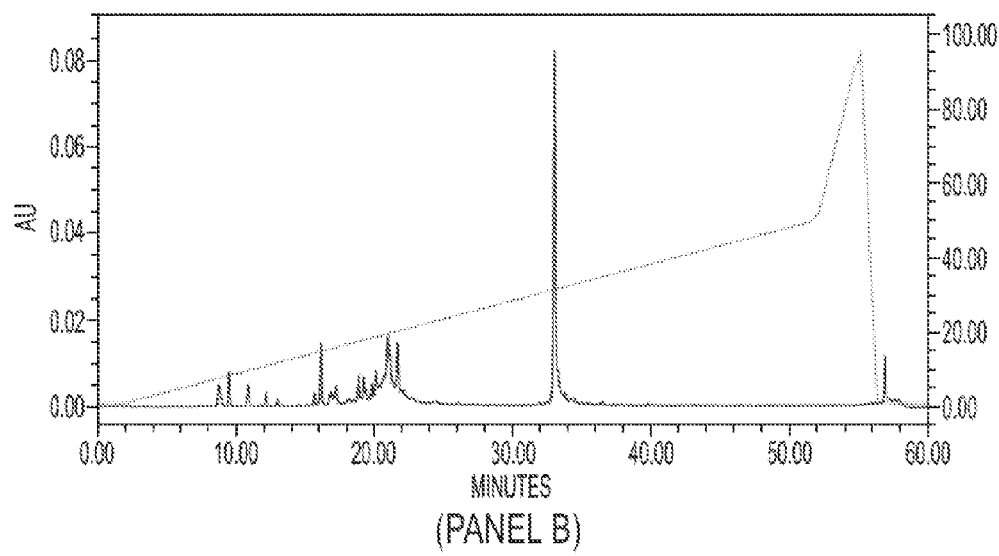
Figure 35:
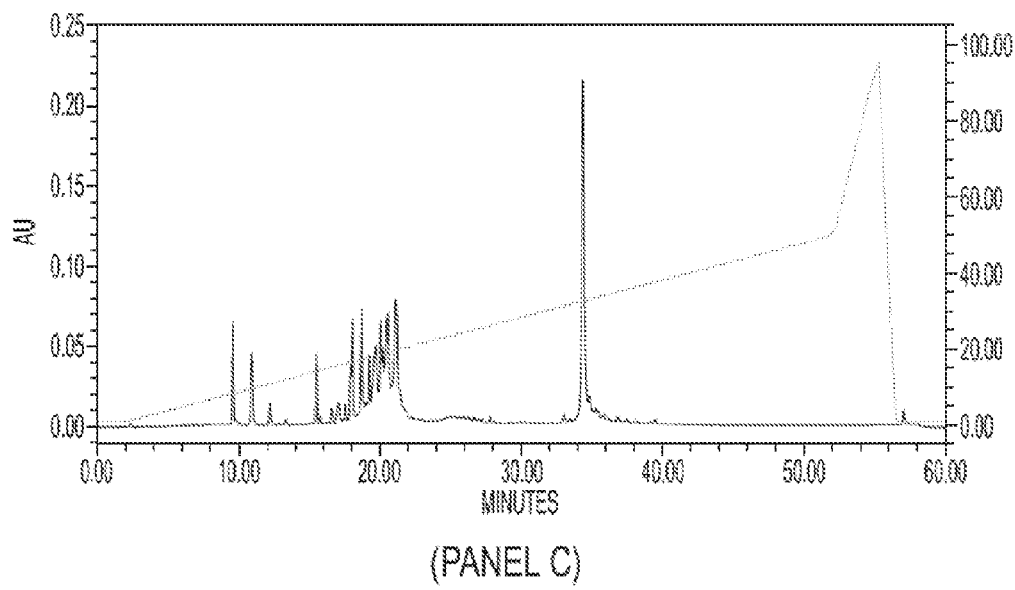
Figure 35:
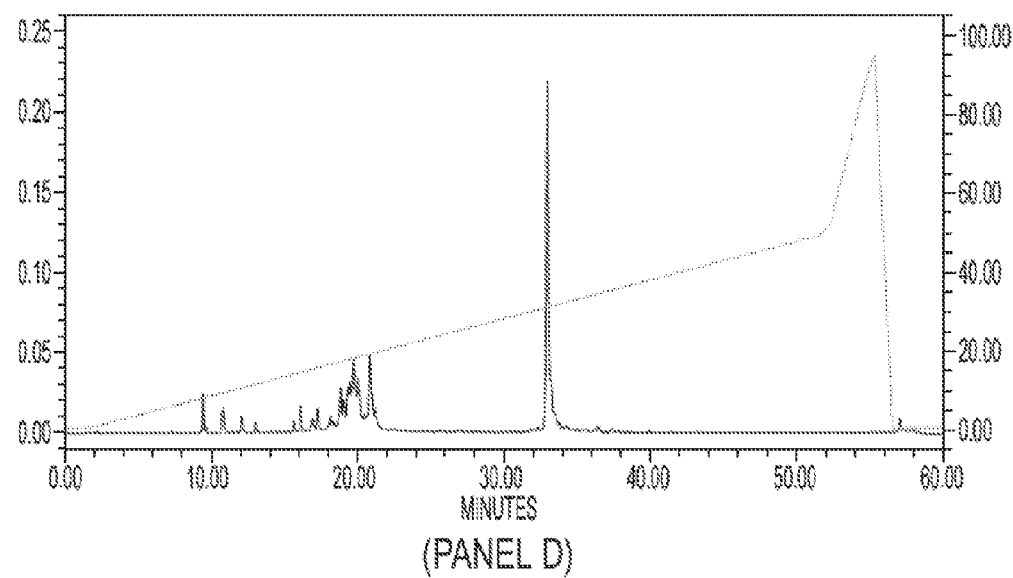
Figure 35:
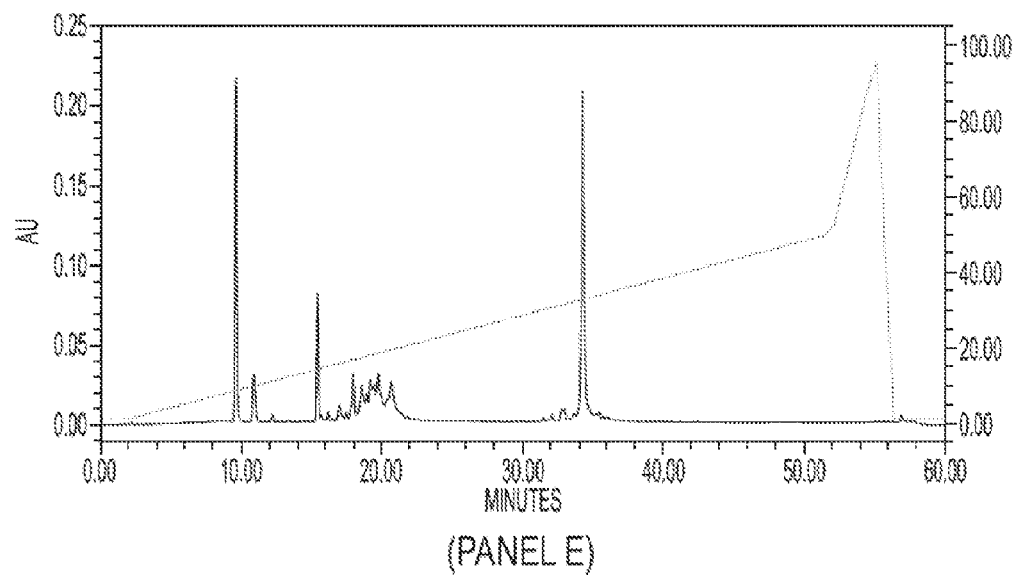
Figure 35:
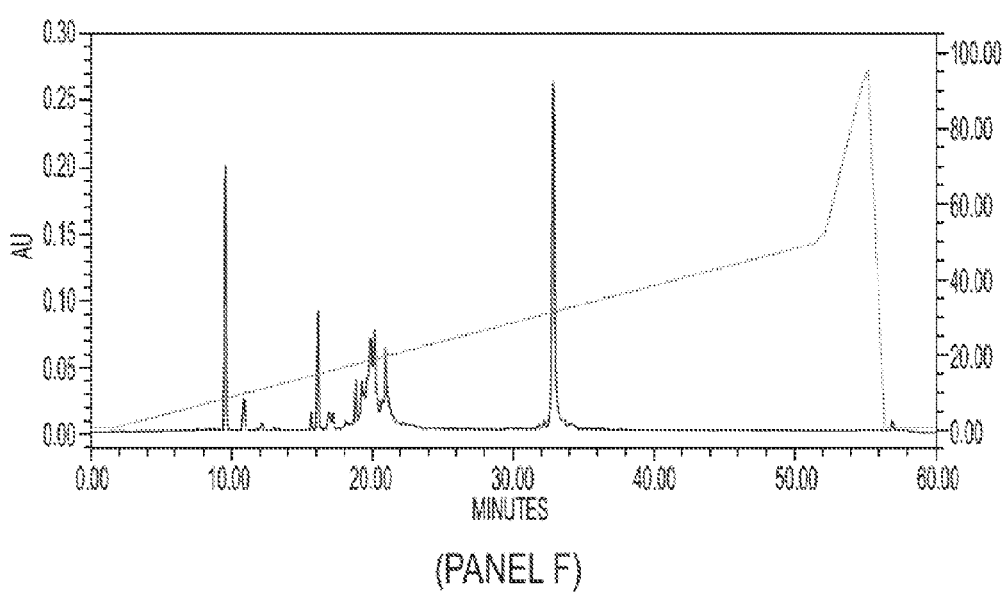
Figure 35:
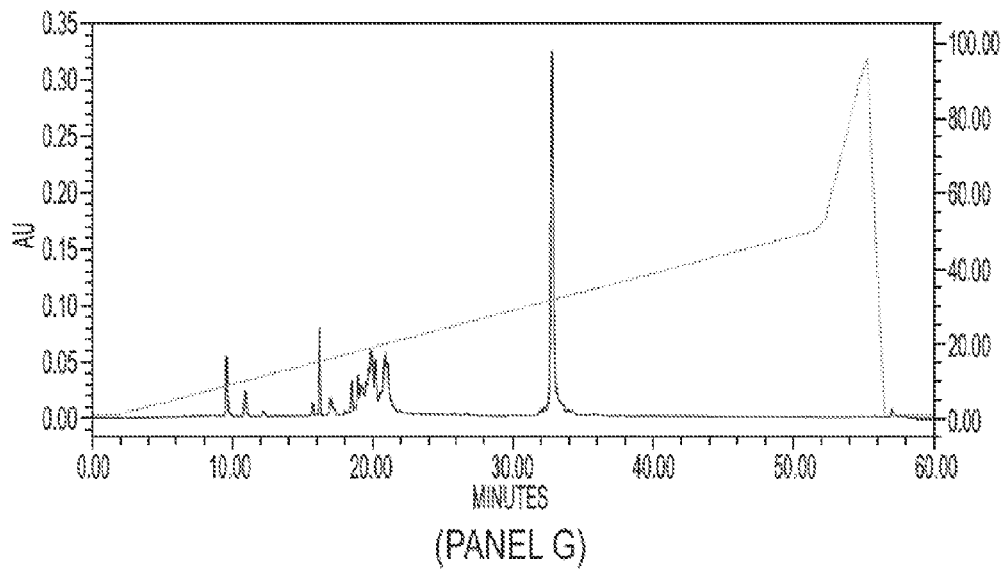
Figure 35:
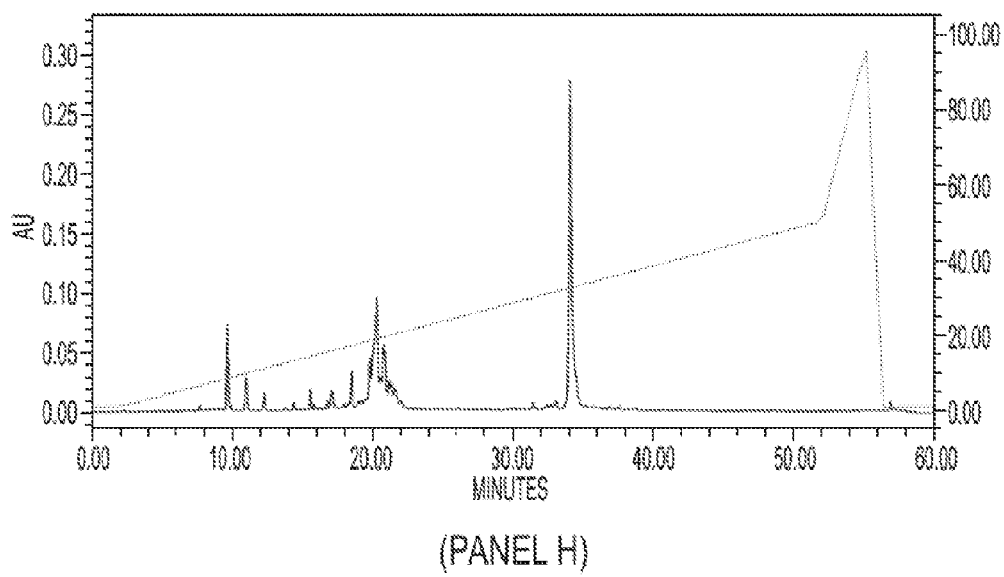
Figure 35:
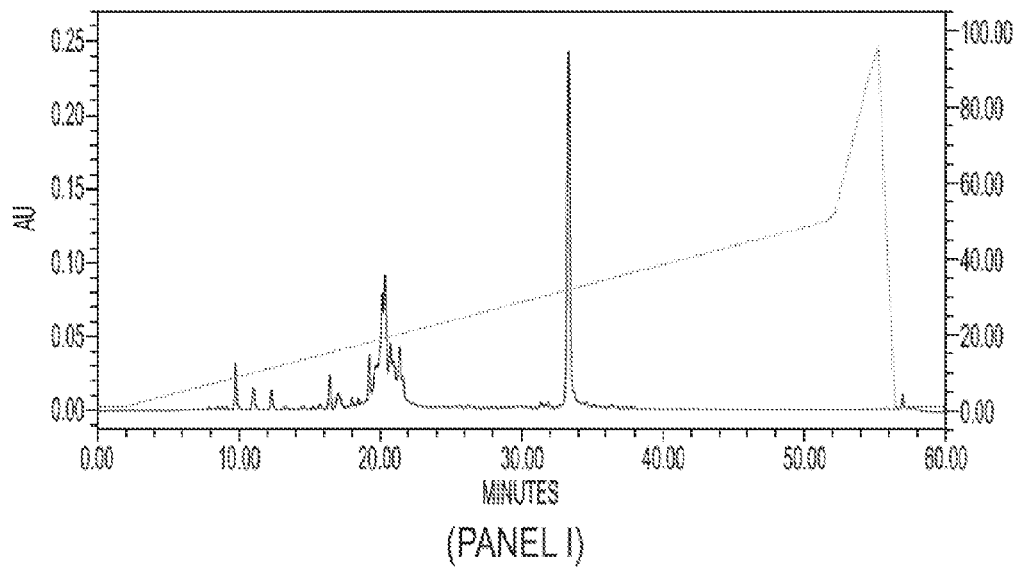
Figure 35:
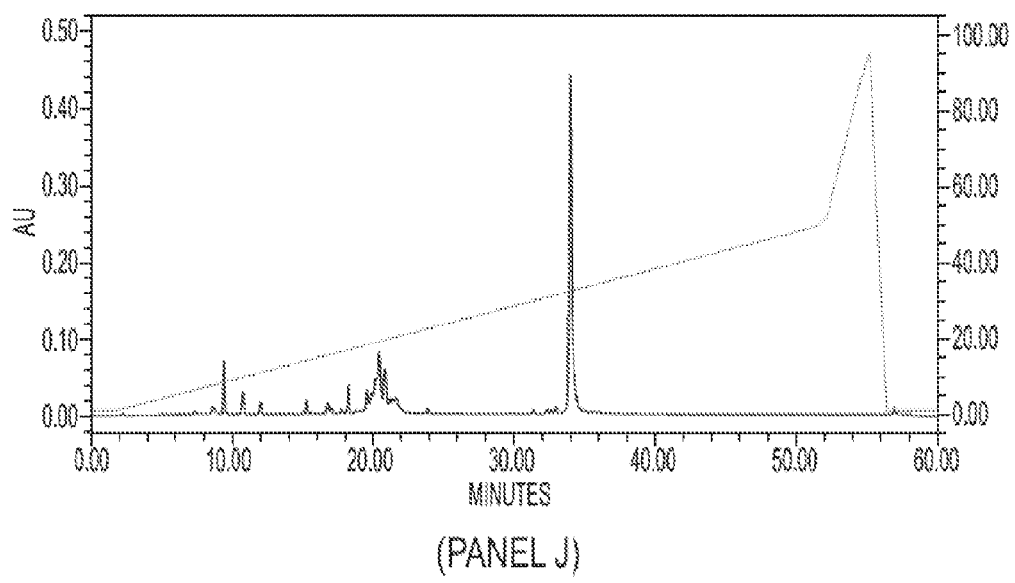
Figure 35:
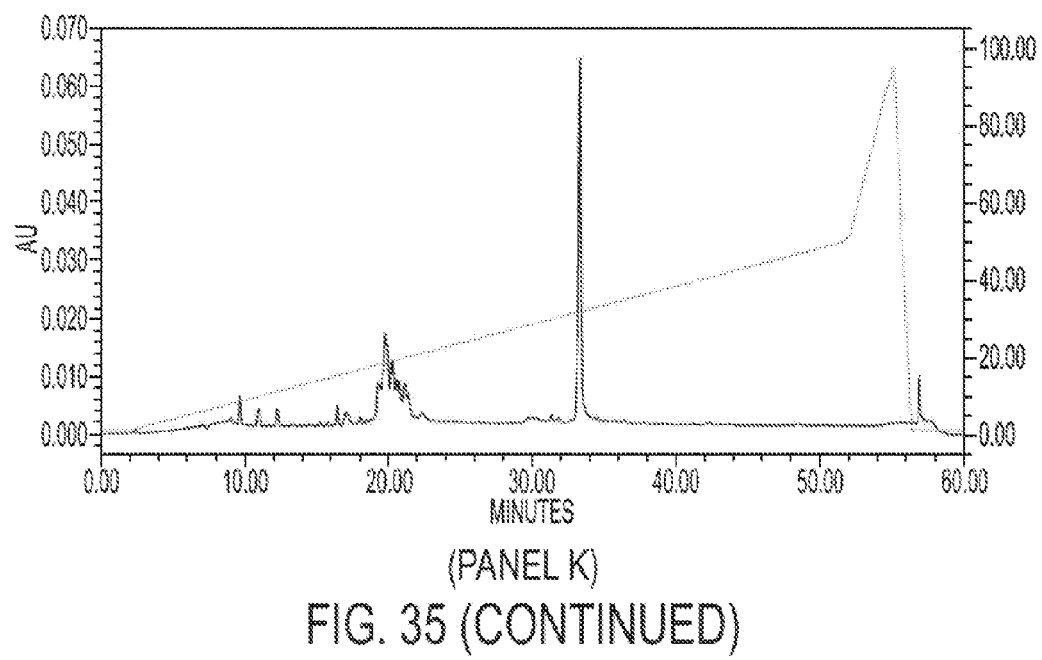

| RP-HPLC of Crude DMT on: | SEQ ID NO: | FIG. 35: |
|---|---|---|
| ONT-75 (All (Rp))-Gs5mCs5mCsTs5mCsAs GsTs5mCsTsGs5mCsTsTs5mCsGs5mCsAs5mCs5mC | 106 | (Panel A) |
| ONT-80 (All (Sp))-Gs5mCs5mCsTs5mCsAs GsTs5mCsTsGs5mCsTsTs5mCsGs5mCsAs5mCs5mC | 106 | (Panel B) |
| ONT-77: (Rp, Rp, Rp, Rp, Rp, Sp, Sp, Sp, Sp, Sp, Sp, Sp, Sp, Sp, Sp, Rp, Rp, Rp, Rp)-Gs5mCs5mCsTs5mCsAs GsTs5mCsTsGs5mCsTsTs5mCsGs5mCsAs 5mCs5mC (5R-10S-4R) | 106 | (Panel C) |

-continued

| RP-HPLC of Crude DMT on: | SEQ ID NO: | FIG. 35: |
|---|---|---|
| ONT-81 (Sp, Sp, Sp, Sp, Sp, Rp, Rp, Rp, Rp, Rp, Rp, Rp, Rp, Rp, Rp, Sp, Sp, Sp)-Gs5mCs5mCsTs5mCsAs GsTs5mCsTsGs5mCsTsTs5mCsGs5mCsAs 5mCs5mC (5S-10R-4S) | 106 | (Panel D) |
| ONT-87 (Rp, Rp, Rp, Rp, Rp, Sp, Sp, Rp, Sp, Sp, Rp, Sp, Sp, Rp, Rp, Rp, Rp, Rp, Rp)-Gs5mCs5mCsTs5mCsAs GsTs5mCsTsGs5mCsTsTs5mCsGs5mCsAs 5mCs5mC (5R-(SSR)$_3$-5R) | 106 | (Panel E) |
| ONT-88 (Sp, Sp, Sp, Sp, Sp, Rp, Rp, Sp, Rp, Rp, Sp, Rp, Rp, Sp, Sp, Sp, Sp, Sp)-Gs5mCs5mCsTs5mCsAs GsTs5mCsTsGs5mCsTsTs5mCsGs5mCsAs 5mCs5mC (5S-(RRS)$_3$-5S) | 106 | (Panel F) |
| ONT-89 (Sp, Rp, Sp, Rp, Sp, Rp, Sp, Rp, Sp, Rp, Sp, Rp, Sp, Rp, Sp, Rp, Sp, Sp)-Gs5mCs5mCsTs5mCsAs GsTs5mCsTsGs5mCsTsTs5mCsGs5mCsAs 5mCs5mC ((SR)$_9$S) | 106 | (Panel G) |
| ONT-82 (All (Rp))-GsTs5mCs5mCs5mCsTsGsAsAsGsAsTsGsTs5mCsAsAsTsGs5mC | 120 | (Panel H) |
| ONT-84 (All (Sp))-GsTs5mCs5mCs5mCsTsGsAsAsGsAsTsGsTs5mCsAsAsTsGs5mC | 120 | (Panel I) |
| ONT-85 (Rp, Rp, Rp, Rp, Rp, Sp, Sp, Sp, Sp, Sp, Sp, Sp, Sp, Sp, Sp, Rp, Rp, Rp, Rp)-GsTs5mCs5mCs5mCsTsGsAsAsGsAsTsGsTs5mCsAsAsTsGs5mC (5R-10S-4R) | 120 | (Panel J) |
| ONT-86 (Sp, Sp, Sp, Sp, Sp, Rp, Rp, Rp, Rp, Rp, Rp, Rp, Rp, Rp, Rp, Sp, Sp, Sp)-GsTs5mCs5mCs5mCsTsGsAsAsGsAsTsGsTs5mCsAsAsTsGs5mC (5S-10R-4S) | 120 | (Panel K) |

Example 53: General IEX-HPLC Method for the Analysis of Crude DMT on and Purified DMT Off Oligonucleotides The present Example describes IEX-HPLC analysis of crude and purified oligonucleotide compositions prepared by chirally controlled synthesis as described herein.

Buffer A: 10 mM TrisHCl, 50% ACN, pH 8.0

Buffer B: 10 mM TrisHCl, 800 mM NaClO$_4$, 50% ACN, pH 8.0

Column: DIONEX, DNAPac, PA-100, Analytical, 4.0×250 mm, Part #063000

Column temperature=60° C.

Signal monitored at 254 and 280 nm

Gradient Used:

| Time (min) | Flow (mL/min) | % A | % B | Curve |
|---|---|---|---|---|
| Initial | | 85 | 15 | |
| 3 | 1 | 85 | 15 | 1 |
| 23 | 1 | 60 | 40 | 6 |
| 25 | 1 | 5 | 95 | 6 |
| 25.5 | 1 | 85 | 15 | 6 |
| 30 | 1 | 85 | 15 | 1 |

Example 54: General UPLC-LCMS Method for the Analysis of Purified DMT Off Oligonucleotides The present Example describes UPLC-LCMS analysis of purified oligonucleotide compositions prepared by chirally controlled synthesis as described herein.

Buffer A: 15 mM TEA, 400 mM HFIP, Water

Buffer B: 50:50 Buffer A/Methanol

Column: UPLC@OST C$_{18}$ 1.7 μm, 2.1×500 mm

Column temperature=50° C.

Gradient Used:

| Time (min) | Flow (mL/min) | % A | % B | Curve |
|---|---|---|---|---|
| Initial | 0.2 | 80 | 20 | |
| 2 | 0.2 | 80 | 20 | 1 |
| 22 | 0.2 | 30 | 70 | 6 |
| 25 | 0.2 | 5 | 95 | 6 |
| 25.5 | 0.2 | 80 | 20 | 6 |
| 30 | 0.2 | 80 | 20 | 1 |

Example 55: General IEX-HPLC Method for the Purification of Crude DMT Off Oligonucleotide The present Example describes IEX-HPLC purification of crude oligonucleotide compositions prepared by chirally controlled synthesis as described herein.

Buffer A: 20 mM NaOH, pH 11.0

Buffer B: 20 mM NaOH, 2.5 M NaCl, pH 11.0

Column: Empty column Waters AP-2 (Waters), custom in-house packed with Source 15Q support (GE Healthcare). Individual purification columns were packed and used for the different stereopure oligonucleotides.

Instrument: AKTA Purifier, equipped with the P-900 pump, the UPC-900 detector and the 50 mL injection SuperLoop (GE Healthcare)

Buffer heater temperature set=70° C.

Signal monitored at 254 nm Fractions volume: 5 mL

Gradient Used:

| Time (min) | Flow (mL/min) | % A | % B | Curve |
|---|---|---|---|---|
| Initial | | 100 | 0 | |
| 25 | 10 | 100 | 0 | 1 |
| 40 | 10 | 85 | 15 | 6 |

| Time (min) | Flow (mL/min) | % A | % B | Curve |
|---|---|---|---|---|
| 60 | 10 | 85 | 15 | 1 |
| 80 | 10 | 70 | 30 | 6 |
| 100 | 10 | 70 | 30 | 1 |
| 140 | 10 | 60 | 40 | 6 |
| 180 | 10 | 60 | 40 | 1 |
| 200 | 10 | 45 | 55 | 6 |
| 210 | 10 | 45 | 55 | 1 |

| Time (min) | Flow (mL/min) | % A | % B | Curve |
|---|---|---|---|---|
| 211 | 10 | 100 | 0 | 6 |
| 235 | 10 | 100 | 0 | 1 |

Collected fractions were individually analyzed by analytical IEX-HPLC using the analytical conditions and gradient described above. Pure fractions were pooled in order to provide purified material of 95% and above purity as determined by the 254 nm UV absorbance profiles.

Figure 36:
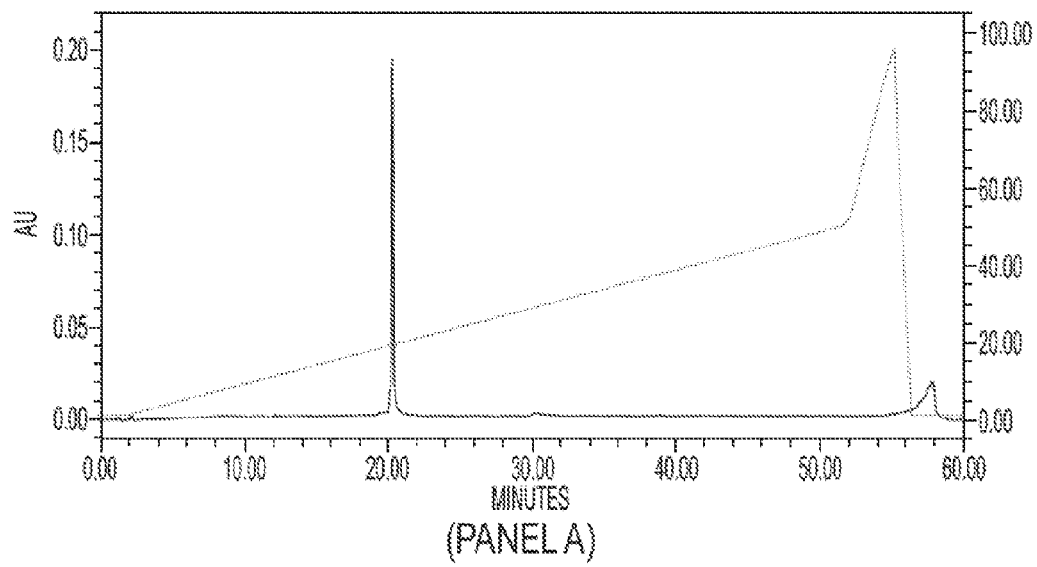
FIG. 36. RP-HPLC of purified DMT off oligonucleotide: ONT-75 (Panel A); ONT-80 (Panel B); ONT-77 (Panel C); ONT-81 (Panel D); ONT-87 (Panel E); ONT-88 (Panel F); ONT-89 (Panel G); ONT-82 (Panel H); ONT-84 (Panel I); ONT-85 (Panel J); ONT-86 (Panel K).
Figure 36:
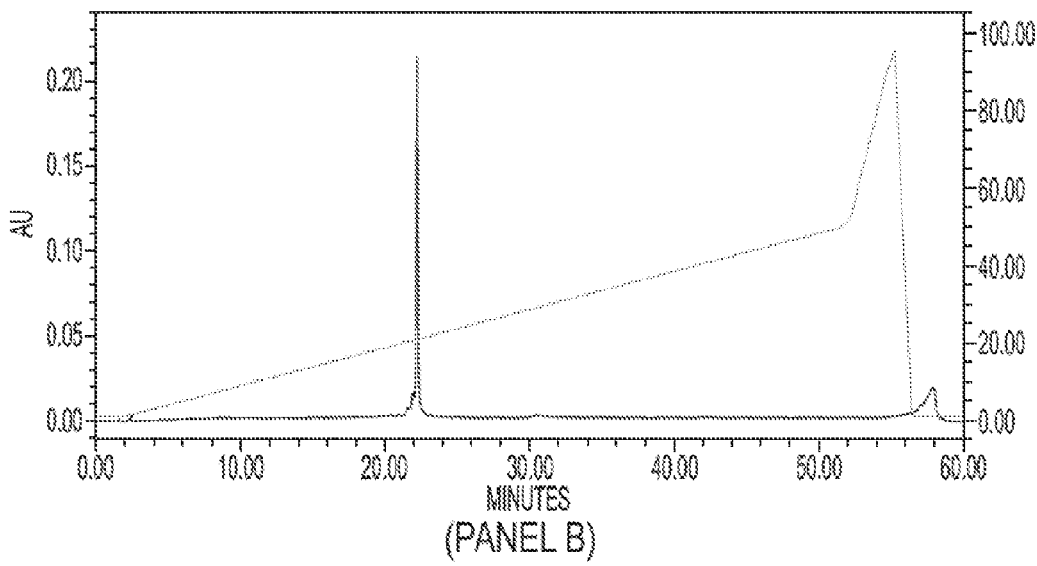
Figure 36:
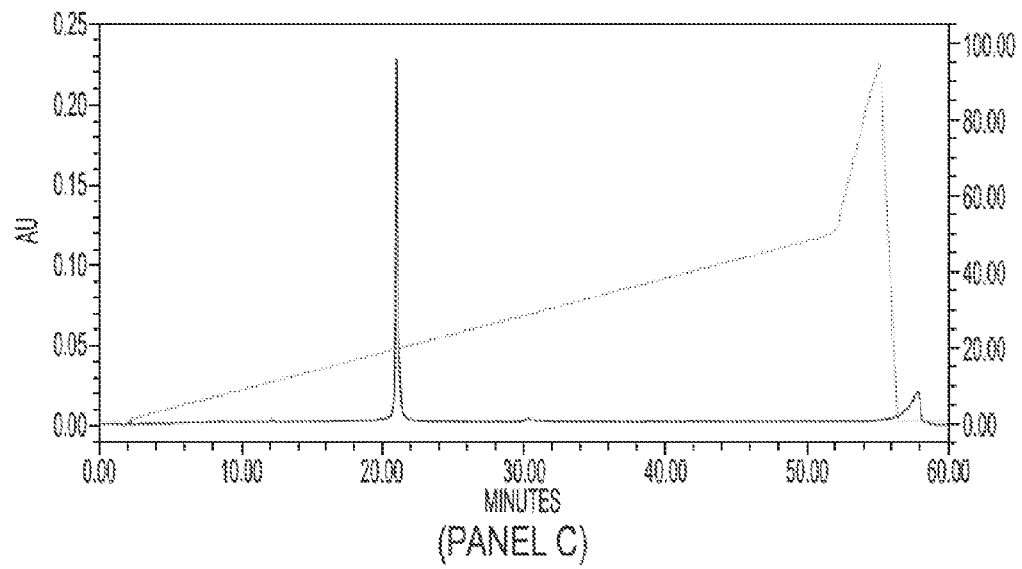
Figure 36:
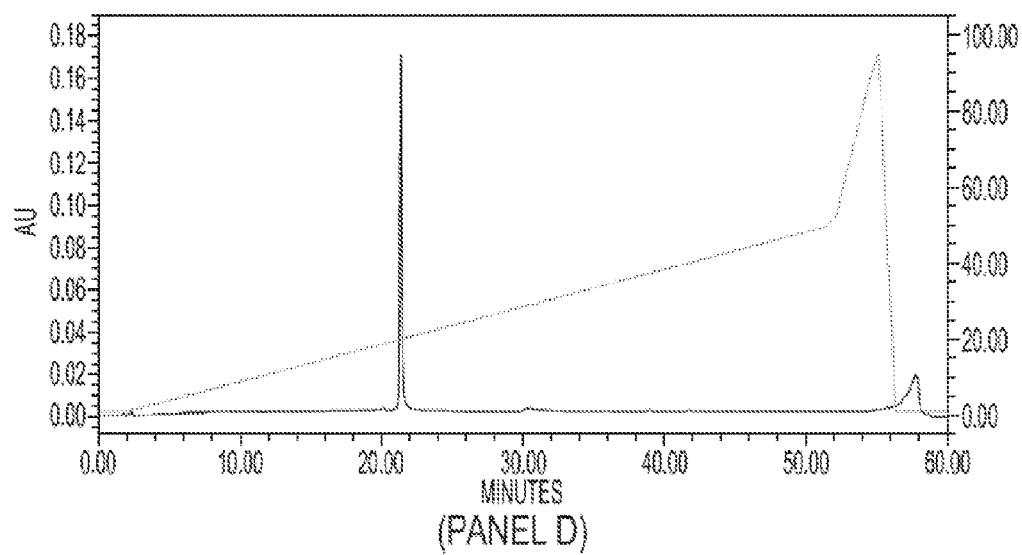
Figure 36:
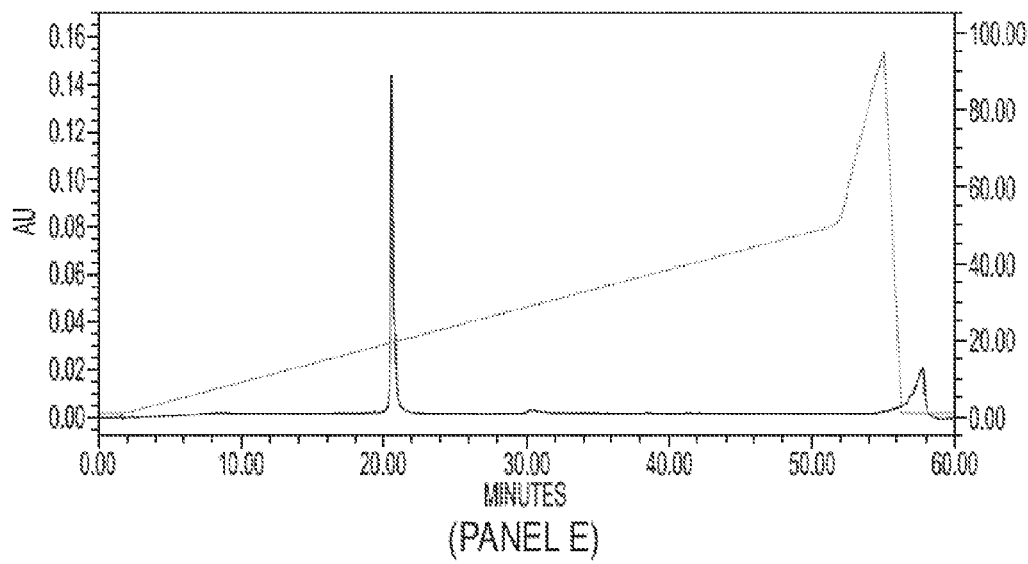
Figure 36:
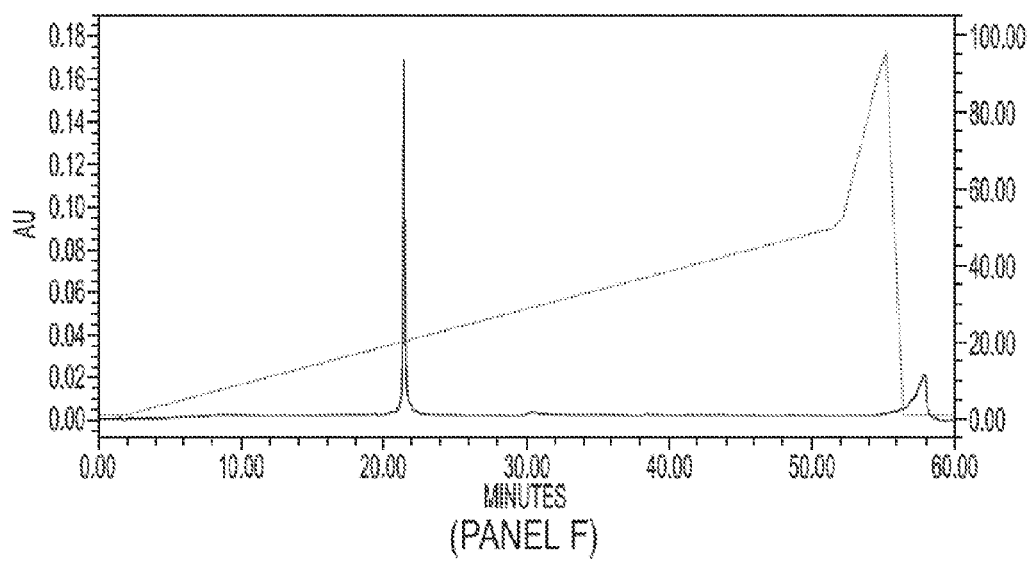
Figure 36:
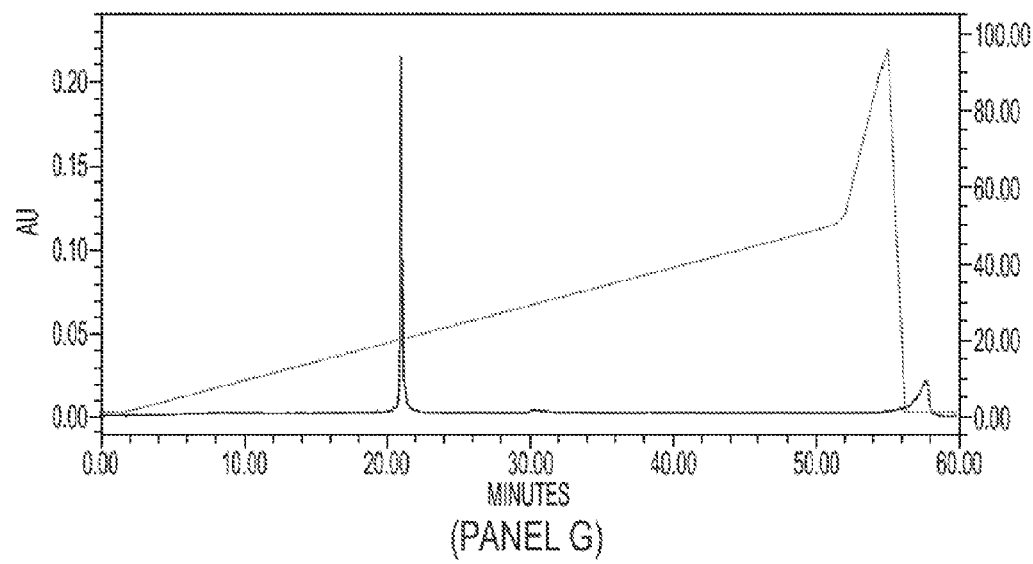
Figure 36:
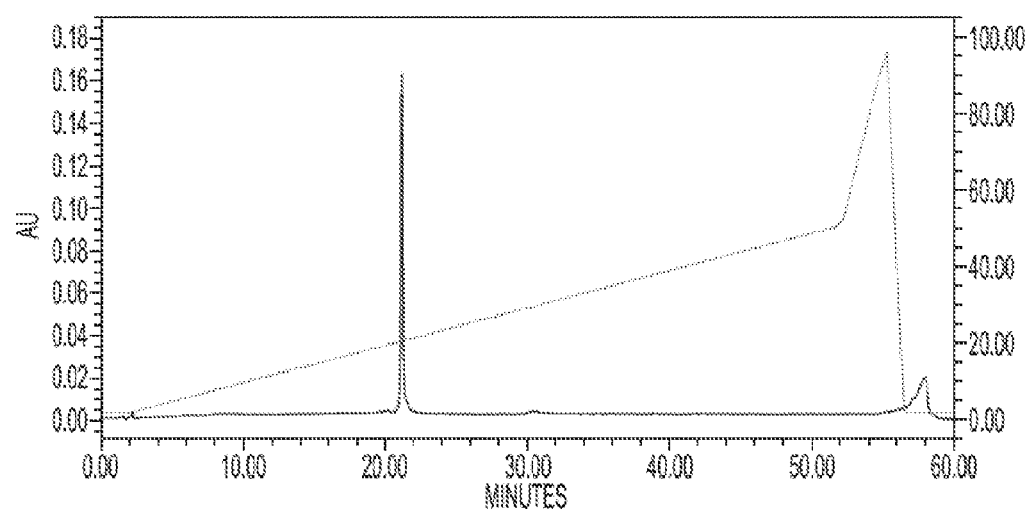
Figure 36:
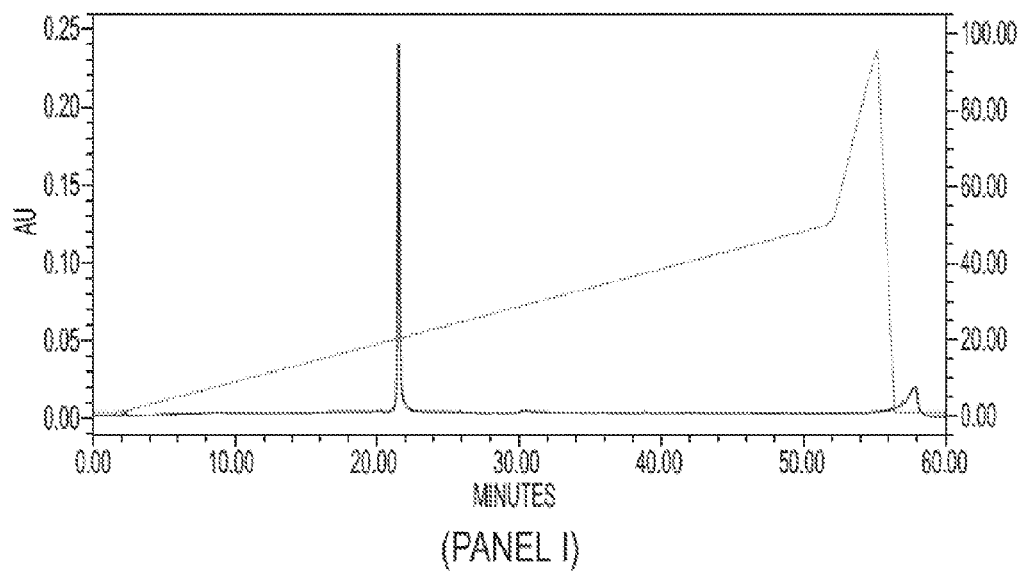
Figure 36:
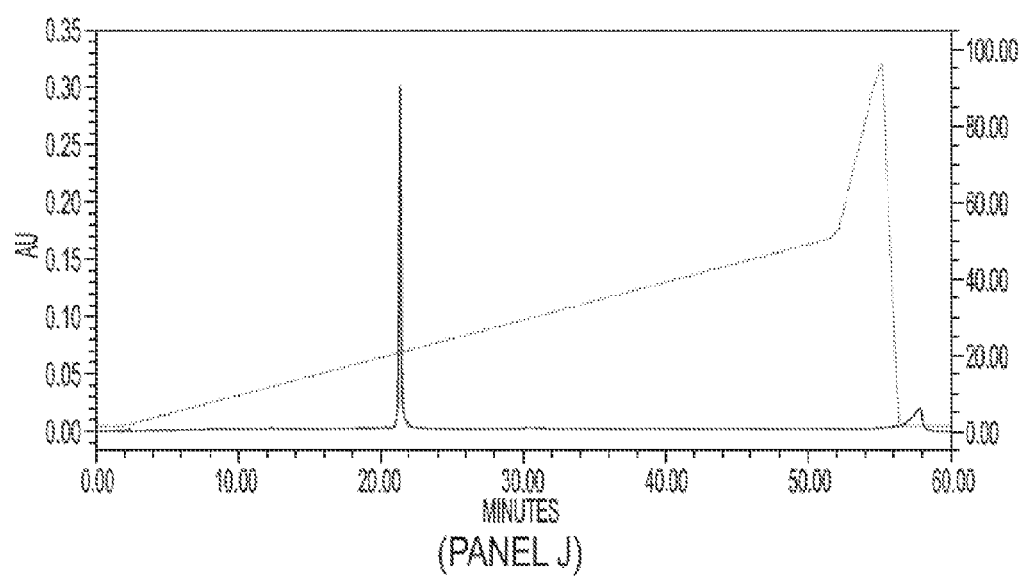
Figure 36:
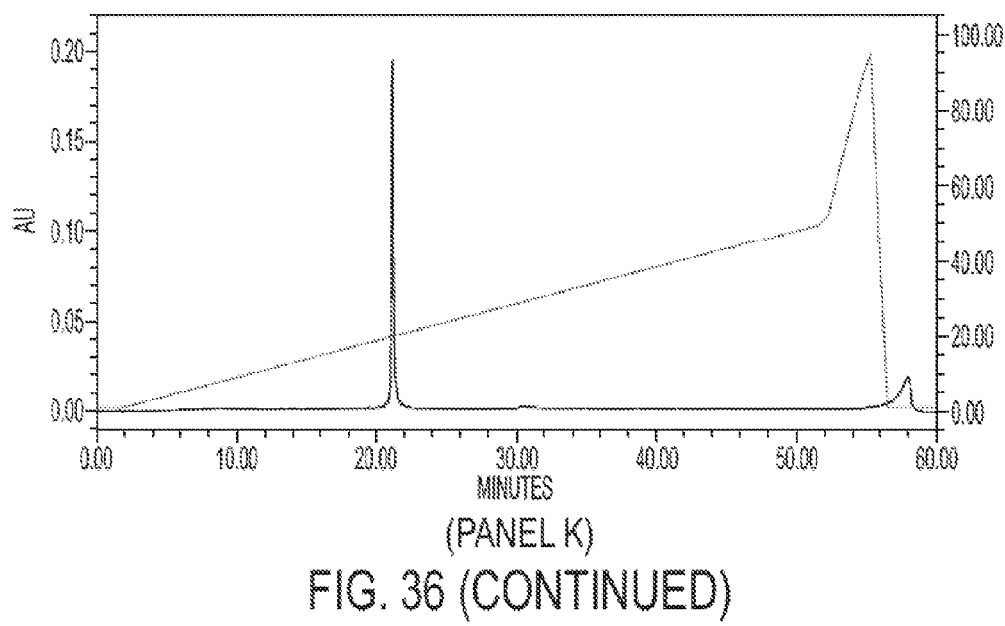

| RP-HPLC of Purified DMT Off | SEQ ID NO: | FIG. 36: |
|---|---|---|
| ONT-75 (All (Rp))-Gs5mCs5mCsTs5mCsAs GsTs5mCsTsGs5mCsTsTs5mCsGs5mCsAs5mCs5mC | 106 | (Panel A) |
| ONT-80 (All (Sp))-Gs5mCs5mCsTs5mCsAs GsTs5mCsTsGs5mCsTsTs5mCsGs5mCsAs5mCs5mC | 106 | (Panel B) |
| ONT-77 (Rp, Rp, Rp, Rp, Rp, Sp, Sp, Sp, Sp, Sp, Sp, Sp, Sp, Sp, Sp, Rp, Rp, Rp, Rp)-Gs5mCs5mCsTs5mCsAs GsTs5mCsTsGs5mCsTsTs5mCsGs5mCsAs 5mCs5mC (5R-10S-4R) | 106 | (Panel C) |
| ONT-81 (Sp, Sp, Sp, Sp, Sp, Rp, Rp, Rp, Rp, Rp, Rp, Rp, Rp, Rp, Rp, Sp, Sp, Sp, Sp)-Gs5mCs5mCsTs5mCsAs GsTs5mCsTsGs5mCsTsTs5mCsGs5mCsAs 5mCs5mC (5S-10R-4S) | 106 | (Panel D) |
| ONT-87 (Rp, Rp, Rp, Rp, Rp, Sp, Sp, Rp, Sp, Sp, Rp, Sp, Sp, Rp, Rp, Rp, Rp, Rp)-Gs5mCs5mCsTs5mCsAs GsTs5mCsTsGs5mCsTsTs5mCsGs5mCsAs 5mCs5mC (5R-(SSR)$_3$-5R) | 106 | (Panel E) |
| ONT-88 (Sp, Sp, Sp, Sp, Sp, Rp, Rp, Sp, Rp, Rp, Sp, Rp, Rp, Sp, Sp, Sp, Sp, Sp)-Gs5mCs5mCsTs5mCsAs GsTs5mCsTsGs5mCsTsTs5mCsGs5mCsAs 5mCs5mC (5S-(RRS)$_3$-5S) | 106 | (Panel F) |
| ONT-89 (Sp, Rp, Sp, Rp, Sp, Rp, Sp, Rp, Sp, Rp, Sp, Rp, Sp, Rp, Sp, Rp, Sp, Rp, Sp)-Gs5mCs5mCsTs5mCsAs GsTs5mCsTsGs5mCsTsTs5mCsGs5mCsAs 5mCs5mC ((SR)$_9$S) | 106 | (Panel G) |
| ONT-82 (All (Rp))-GsTs5mCs5mCs5mCsTsGsAsAsGsAsTsGsTs5mCsAsAsTsGs5mC | 120 | (Panel H) |
| ONT-84 (All (Sp))-GsTs5mCs5mCs5mCsTsGsAsAsGsAsTsGsTs5mCsAsAsTsGs5mC | 120 | (Panel I) |
| ONT-85 (Rp, Rp, Rp, Rp, Rp, Sp, Sp, Sp, Sp, Sp, Sp, Sp, Sp, Sp, Sp, Rp, Rp, Rp, Rp)-GsTs5mCs5mCs5mCsTsGsAsAsGsAsTsGsTs5mCsAsAsTsGs5mC (5R-10S-4R) | 120 | (Panel J) |
| ONT-86 (Sp, Sp, Sp, Sp, Sp, Rp, Rp, Rp, Rp, Rp, Rp, Rp, Rp, Rp, Rp, Sp, Sp, Sp, Sp)-GsTs5mCs5mCs5mCsTsGsAsAsGsAsTsGsTs5mCsAsAsTsGs5mC (5S-10R-4S) | 120 | (Panel K) |

TABLE E-21

Compilation of the physico-chemical properties for the stereopure phosphorothioate oligonucleotides synthesized as described in Example XX.

| sequence ID | sequence | stereo architecture | $t_R$ IEX-HPLC (min) | Calc MW | Found MW |
|---|---|---|---|---|---|
| ONT-41 | A | Stereorandom diastereomixture | 17.34 | 7177.2 | 7175.7 |
| ONT-75 | A | All Rp | 16.44 | 7177.2 | 7177.0 |
| ONT-77 | A | 5R-10S-4R | 17.44 | 7177.2 | 7177.5 |
| ONT-80 | A | All Sp | 18.13 | 7177.2 | 7175.5 |
| ONT-81 | A | 5S-10R-4S | 17.67 | 7177.2 | 7175.8 |
| ONT-87 | A | 5R-(SSR)$_3$-5R | 13.64 | 7177.2 | — |
| ONT-88 | A | 5S-(RRS)$_3$-5S | 14.88 | 7177.2 | 7177.0 |
| ONT-89 | A | (SR)$_9$S | 14.25 | 7177.2 | — |
| ONT-83 | B | Stereorandom diastereomixture | 17.02 | 7233.2 | 7231.8 |
| ONT-82 | B | All Rp | 16.43 | 7233.2 | 7231.6 |
| ONT-84 | B | All Sp | 19.51 | 7233.2 | 7232.1 |

TABLE E-21-continued

Compilation of the physico-chemical properties for the
stereopure phosphorothioate oligonucleotides synthesized as described in Example XX.

| sequence ID | sequence | stereo architecture | $t_R$ IEX-HPLC (min) | Calc MW | Found MW |
|---|---|---|---|---|---|
| ONT-85 | B | 5R-10S-4R | 18.76 | 7233.2 | 7231.1 |
| ONT-86 | B | 5S-10R-4S | 18.75 | 7233.2 | 7230.9 |

Sequence A: human ApoB sequence 5'-Gs5mCs5mCsTs5mCsAsGsTs5mCsTsGs5mCsTsTs5mCsGs5mCsAs5mCs5mC-3' (SEQ ID NO: 106).
Sequence B: mouse ApoB sequence 5'-GsTs5mCs5mCs5mCsTsGsAsAsGsAsTsGsTs5mCsAs AsTsGs5mC-3' (SEQ ID NO: 120).
Underlined nucleotides designate 2'-O-MOE. s = phosphorothioate linkage. 5mC = 5-methyl-2'-deoxycytidine. 5mC = 5-methyl-2'-O-MOE-cytidine. Stereo architecture describes the stereoisomer nature (Rp/Sp) of each phosphorus atom in a given phosphorothioate linkage of the oligonucleotide. Retention time ($t_R$) in IEX-HPLC and Found molecular weight (MW) values were obtained using the corresponding analytical methods for the purified compounds (described above).

Example 56: General RP-HPLC Method for the Overlay Analyses of Purified DMT Off Oligonucleotides The present Example describes RP-HPLC analysis of purified oligonucleotide compositions prepared by chirally controlled synthesis as described herein.

Buffer A: 50 mM TEAA, pH 7.0
Buffer B: ACN
Column: XBridge $C_{18}$, 3.5 µm, $C_{18}$, 4.6×50 mm
Column temperature=50° C.
Signal monitored at 254 and 280 nm
Gradient Used:

| Time(min) | Flow (mL/min) | % A | % B | Curve |
|---|---|---|---|---|
| Initial |  | 95 | 5 |  |
| 2 | 1 | 95 | 5 | 1 |
| 52 | 1 | 70 | 30 | 6 |
| 54 | 1 | 5 | 95 | 6 |
| 54.5 | 1 | 5 | 95 | 1 |
| 55 | 1 | 99 | 1 | 6 |
| 60 | 1 | 99 | 1 | 1 |

Figure 37:
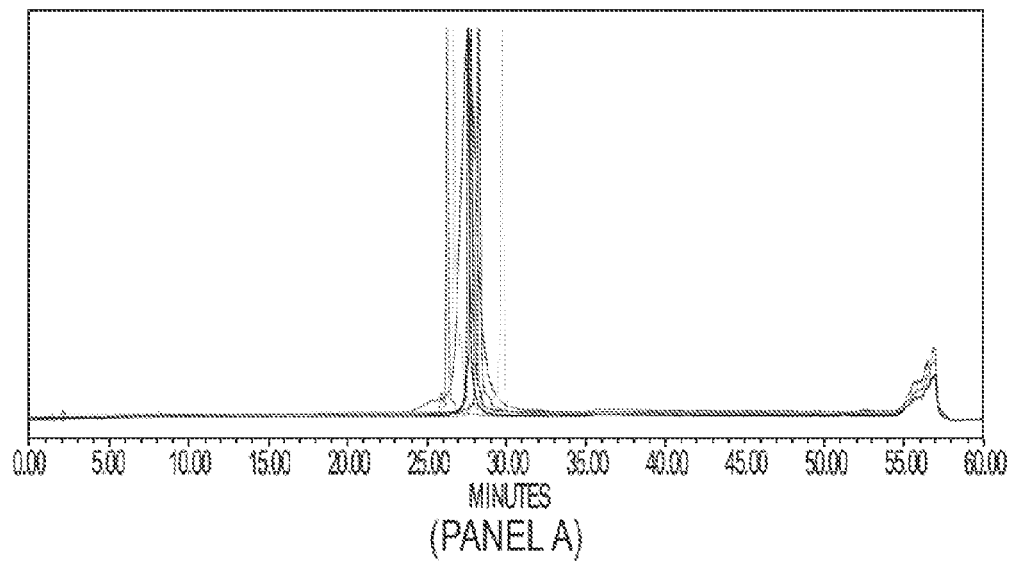
FIG. 37. Overlay of RP-HPLC traces of purified DMT off oligonucleotide: ONT-75, ONT-77, ONT-80, ONT-81, ONT-87, ONT-88, ONT-89, and ONT-41 (Panel A); expanded view of overlay of ONT-75, ONT-77, ONT-80, ONT-81, ONT-87, ONT-88, ONT-89, and ONT-41 (Panel B).
Figure 37:
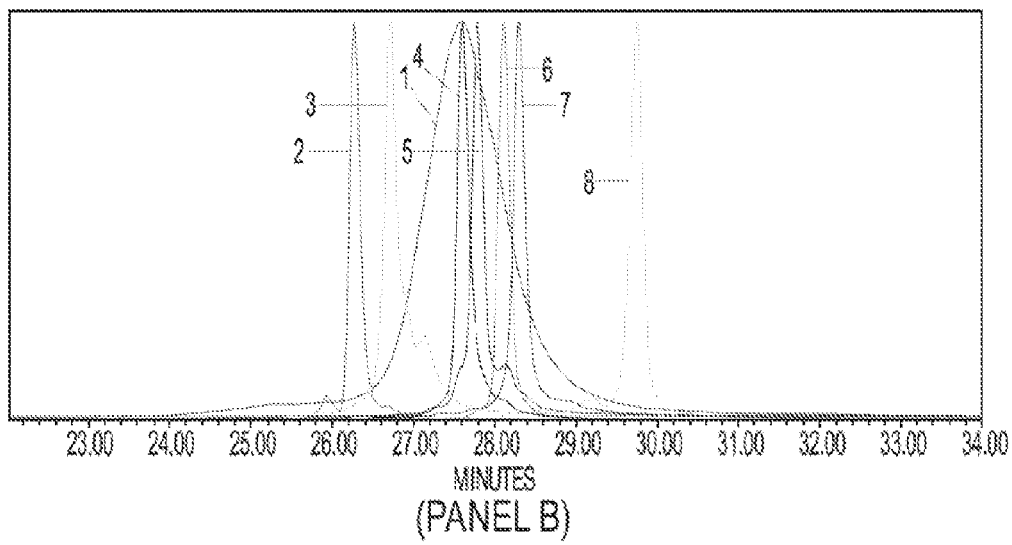

Panel A of FIG. 37 is an overlay of RP-HPLC traces of Purified DMT Off Oligonucleotide ONT-75, ONT-77, ONT-80, ONT-81, ONT-87, ONT-88, ONT-89 and ONT-41 (diastereomixture)-Gs5mCs5mCsTs5mCsAsGsTs5mCsTsGs5mCsTsTs5mCsGs5mCsAs5mCs5mC (SEQ ID NO:

Panel B of FIG. 37 shows an expanded view of Panel A, with each curve labeled as follows:

| Curve # | Oligonucleotide |
|---|---|
| 1 | diastereomixture (ONT-41) |
| 2 | all-Rp (ONT-75) |
| 3 | 5R-(SSR)$_3$-5R (ONT-87) |
| 4 | (SR)$_9$-S (ONT-89) |
| 5 | 5R-10S-4R (ONT-77) |
| 6 | 5S-10R-4S (ONT-81) |
| 7 | 5S-(RRS)$_3$-5S (ONT-88) |
| 8 | all-Sp (ONT-80) |

Figure 38:
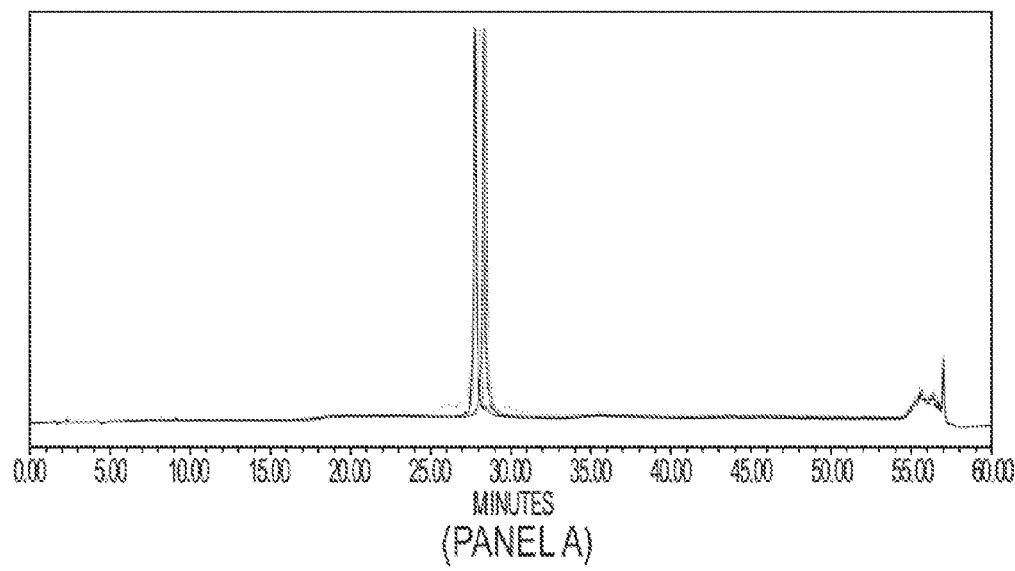
FIG. 38. Overlay of RP-HPLC traces of purified DMT off oligonucleotide: ONT-82, ONT-84, ONT-85, ONT-86, and ONT-83 (Panel A); expanded view of overlay of ONT-82, ONT-84, ONT-85, ONT-86, and ONT-83 (Panel B).
Figure 38:
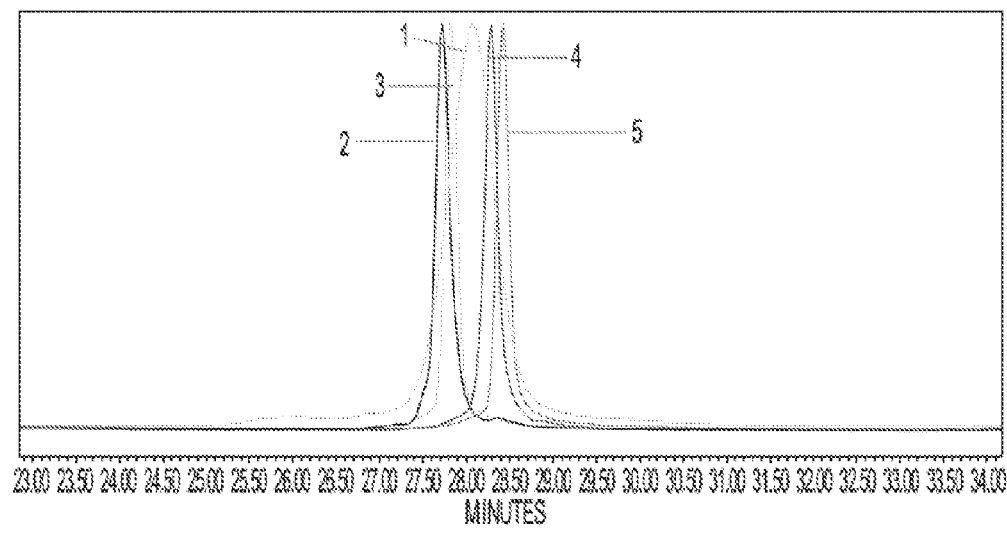

Panel A of FIG. 38 is an overlay of RP-HPLC of Purified DMT Off Oligonucleotide ONT-82, ONT-84, ONT-85, ONT-86, and ONT-83 (diastereomixture)-GsTs5mCs5mCs5mCsTsGsAsAsGsAsTsGsTs5mCsAsAsTsGs5mC (SEQ ID NO: 120)

Panel B of FIG. 38 shows an expanded view of Panel A, with each curve labeled as follows:

| Curve # | Oligonucleotide |
|---|---|
| 1 | diastereomixture (ONT-83) |
| 2 | all-Rp (ONT-82) |
| 3 | 5S-10R-4S (ONT-86) |
| 4 | 5R-10S-4R (ONT-85) |
| 5 | all-Sp (ONT-84) |

Example 57: Thermal Denaturation Experiment (Tm)

The present Example describes characterization of chirally controlled oligonucleotide compositions using thermal denaturation.

Each DNA strand was mixed with its complementary RNA strand in equimolar concentration of 1 µM in 1×PBS. Total 3 mL solution was prepared for each duplex and the mixture was heated at 90° C. for 2 min and was allowed to cool down over the course of several hours. The mixtures were then stored at 4° C. for 2 hrs. Absorbance at 254 nm was recorded at an interval of 0.5 min starting the temperature gradient from 15.0° C. to 95.0° C. with rise of 0.5° C./minute, using Cary100 Series (Agilent Technologies). The 254 nm absorbance was plotted against the temperature and the Tm values were calculated from the respective first derivative of each curve.

Figure 39:
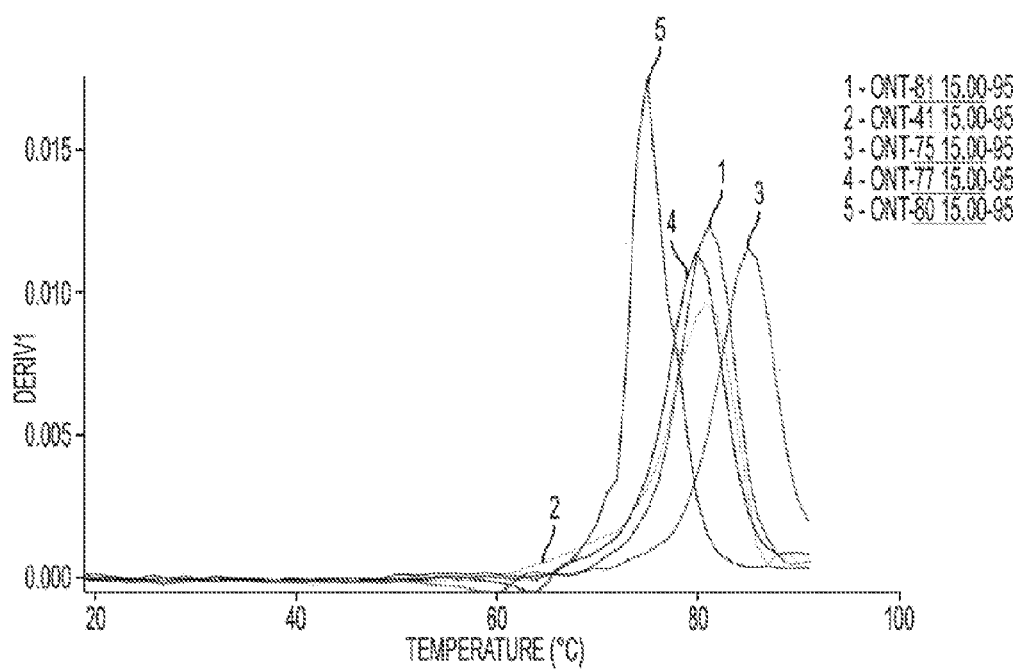
FIG. 39. Tm overlay of chirally controlled oligonucleotides ONT-81, ONT-41, ONT-75, ONT-77, and ONT-80.

FIG. 39 presents a Tm overlay of chirally controlled oligonucleotides and stereorandom oligonucleotide.

FIG. 39 illustrates the difference in Tm between four stereopure diastereoisomer phosphorothioate oligonucleotides (all-Rp 20-mer, all-Sp 20-mer, 5R-10S-4R and 5S-10R-4S gapmers) and the stereorandom phosphorothioate oligonucleotide. Full Rp phosphorothioate DNA demonstrates the highest affinity towards complementary RNA (Tm=85.1° C.) when compared to full Sp 20-mer (Tm=75.1° C.) which has the lowest affinity. 5R-10S-4R and 5S-10R-4S gapmers and the stereorandom phosphorothioate oligonucleotides all showed intermediates values (Tm range=80.1-81.2° C.).

Table E-22, below, gives Tm values for the studied stereopure and stereorandom phosphorothioate oligonucleotides having the human ApoB sequence 5'-Gs5mCs5mCsTs5mCsAsGsTs5mCsTsGs5mCsTsTs5mCsGs5mCsAs5mCs5mC-3' (SEQ ID NO: 106) with various stereochemistry architectures on the phosphorothioate backbone.

TABLE E-22

| sequence ID | stereo architecture | Tm (° C.) |
|---|---|---|
| ONT-41 | Stereorandom diastereomixture | 81.0 |
| ONT-75 | All Rp | 85.1 |
| ONT-77 | 5R-10S-4R | 80.1 |
| ONT-80 | All Sp | 75.1 |
| ONT-81 | 5S-10R-4S | 81.2 |

Example 58: Preparation of Exemplary Chirally Controlled siRNA Oligonucleotides Targeting PCSK9

Proprotein convertase subtilisin/kexin type 9 (PCSK9), is an enzyme involved in cholesterol metabolism. PCSK9 binds to the receptor for low density lipoprotein (LDL), triggering its destruction. Although LDL associated with the receptor is also eliminated when the receptor is destroyed, the net effect of PCSK9 binding in fact increases LDL levels, as the receptor would otherwise cycle back to the cell surface and remove more cholesterol.

Several companies are developing therapeutic agents that target PCSK9. Of particular relevance to the present disclosure, each of Isis Pharmaceuticals, Santaris Pharma, and Alnylam Pharmaceuticals is developing a nucleic acid agent that inhibits PCSK9. The Isis Pharmaceuticals product, an antisense oligonucleotide, has been shown to increase expression of the LDLR and decrease circulating total cholesterol levels in mice (Graham et al "Antisense inhibition of proprotein convertase subtilisin/kexin type 9 reduces serum LDL in hyperlipidemic mice". *J. Lipid Res.* 48 (4): 763-7, April 2007). Initial clinical trials with the Alnylam Pharmaceuticals product, ALN-PCS, reveal that RNA interference offers an effective mechanism for inhibiting PCSK9 (Frank-Kamenetsky et al "Therapeutic RNAi targeting PCSK9 acutely lowers plasma cholesterol in rodents and LDL cholesterol in nonhuman primates". *Proc. Natl. Acad. Sci. U.S.A.* 105 (33): 11915-20, August 2008).

The present Example describes preparation of a variety of chirally controlled or stereorandom siRNA agents directed to PCSK9. Specifically, this Example describes preparation of each of the following oligonucleotide compositions as illustrated in Table E-23 below:

TABLE E-23

| ONT # | SEQ ID NO: | Sequence | Type |
|---|---|---|---|
| ONT-106 | 121 | (Rp)-uucuAGAccuGuuuuGcuudT*dT | PCSK9 sense |
| ONT-107 | 121 | (Sp)-uucuAGAccuGuuuuGcuudT*dT | PCSK9 sense |
| ONT-108 | 122 | (Rp)-AAGcAAAAcAGGUCuAGAAdT*dT | PCSK9 antisense |
| ONT-109 | 122 | (Sp)-AAGcAAAAcAGGUCuAGAAdT*dT | PCSK9 antisense |
| ONT-110 | 122 | (Rp, Rp)-a*AGcAAAAcAGGUCuAGAAdT*dT | PCSK9 antisense |
| ONT-111 | 123 | (Sp, Rp)-a*GcAAAAcAGGUCuAGAAdT*dT | PCSK9 antisense |
| ONT-112 | 123 | (Sp, Sp)-a*GcAAAAcAGGUCuAGAAdT*dT | PCSK9 antisense |
| ONT-113 | 123 | (Rp, Sp)-a*GcAAAAcAGGUCuAGAAdT*dT | PCSK9 antisense |

NOTE:
lower case letters represent 2'OMe RNA residues; capital letters represent 2'OH RNA residues; and bolded and italicized "*s*" indicates a phosphorothioate moiety.

Lcaa-CPG-500 used in the preparation of these oligonucleotides was prepared according to the following reaction:

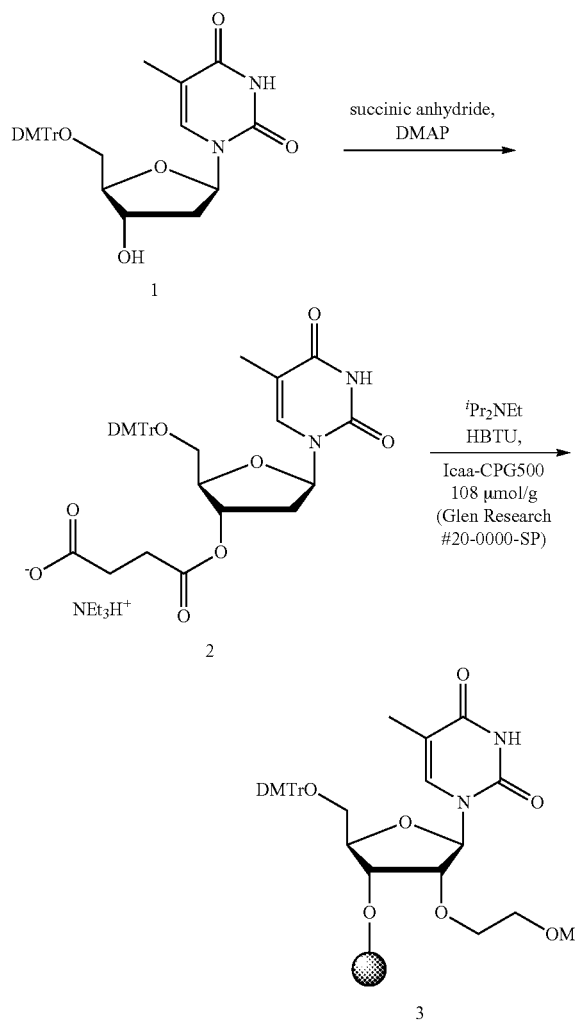

In particular, 5'-O-DMTr-2'-deoxythymidine (1) (4.28 g, 7.86 mmol) was dissolved in anhydrous DCM (50 mL) and mixed with 2 equiv of succinic anhydride (1.57 g, 15.7 mmol) and 3 equiv of 4-N,N-dimethylaminopyridine (2.88 g, 23.6 mmol). The reaction was stirred under Argon at room temperature. After complete consumption of the starting material as determined by TLC (1 hour), the solvents were evaporated to dryness, the crude residue was dissolved in DCM containing 1% triethylamine then purified by flash silica gel chromatography using a gradient of 0-2% of MeOH in DCM containing 2% triethylamine. Yield of pure compound (2) after evaporation was 5.5 g, 94%. The resulting 5'-O-DMTr-2'-deoxythymidine-3'-O-succinate (2) (0.60 g, 0.81 mmol), N,N-diisopropylethylamine (0.71 mL, 4.02 mmol) and CPG-500 (10 g) were taken up in DMF (50 mL) then HBTU (0.37 g, 0.97 mmol) was added. The mixture was shaken for 2 h then filtered. The support was washed with DMF, MeOH and finally, DCM then dried in vacuo. Trityl cation analysis (monitoring at 504 nm) showed that the loading of nucleoside on the support (3) was 38 μmol/g.

Each oligonucleotide, containing 2'-OH and 2'-OMe phosphodiester and stereodefined 2'-deoxy and 2'-OMe phosphorothioate diester internucleotidic linkages as indicated above in Table E-23, was synthesized on an ABI 394 DNA/RNA synthesizer according to the cycles summarized in Table E-24 and Table E-25 respectively, using a 10 μmol capacity synthesis column loaded with 130 mg (4.9 μmol) of succinyl linked 5'-O-DMTr-2'-deoxythymidine (38 μmol/g). Prior to synthesis, a preliminary capping step (capping 2) was performed and the synthesis was terminated with removal of the terminal 5'-O-DMTr groups. The oxidation step was performed using a commercially available 5-6 M solution of tert-butyl hydroperoxide (TBHP) in decane which was then diluted with four parts dichloromethane. The stereospecific sulfurization step was performed using the 0.3 M S-cyanoethylmethylthiosulfonate reagent following the coupling of the corresponding chiral phosphoramide and the two-step capping process (Table E-25).

Once the automated oligonucleotide synthesis cycle was completed and the final 5'-O-DMTr group was removed, the synthesis column was taken off the DNA/RNA synthesizer and dried under vacuum. 10 mL solution of 0.5 M 1,5-diazabicyclo[4.3.0]non-5-ene (DBN), 0.25 M N,O-bis(trimethylsilyl)trifluoroacetamide (BSTFA) in ACN was continuously added to the support through the synthesis column for 1 min without stopping the flow using a syringe attached to one end of the synthesis column. The support was then washed with anhydrous ACN and dried under vacuum. Then, the dried support was transferred into an empty screw-cap plastic vial and treated with 40% MeNH$_2$ aqueous solution (0.5 mL) at 60° C. for 10 min. After that, the vial was immediately cooled down and after dilution with DMSO (0.5 mL), the support was removed by filtration, washed again with DMSO (1 mL) and filtered. The filtrate was cooled down and then immediately treated with 3HF.Et$_3$N (0.75 mL) at 60° C. for 10 min, then immediately frozen and stored at 4° C. prior to purification.

TABLE E-24

Summary for Oligonucleotide Synthesis on a DNA/RNA Synthesizer ABI 394 (2'-O-TBDMS and 2'-OMe substituted RNA cycle)

| step | reaction | reagent | delivery time (sec) | wait time (sec) |
|---|---|---|---|---|
| 1 | detritylation | 3% TCA in DCM | 3 + 120 + 10 | N. A. |
| 2 | coupling | 0.15M phosphoramidite in ACN + 2M CMPT in ACN | 7 + 6 | 30 + 600 |
| 3 | capping | 5% Pac$_2$O in THF/2,6-lutidine + 16% NMI in THF | 10 | 20 |
| 4 | oxidation | 1.1M tert-butyl hydroperoxide in 4:1 dichloromethane:decane | 20 | 110 |

TABLE E-25

Summary for Oligonucleotide Synthesis on a DNA/RNA Synthesizer ABI 394 (stereodefined phosphorothioate 2'-deoxy and 2'-OMe RNA cycle)

| step | reaction | reagent | delivery time (sec) | wait time (sec) |
|---|---|---|---|---|
| 1 | detritylation | 3% TCA in DCM | 3 + 120 + 10 | N.A. |

TABLE E-25-continued

Summary for Oligonucleotide Synthesis on a DNA/RNA Synthesizer ABI 394 (stereodefined phosphorothioate 2'-deoxy and 2'-OMe RNA cycle)

| step | reaction | reagent | delivery time (sec) | wait time (sec) |
|---|---|---|---|---|
| 2 | coupling | 0.15M chiral phosphoramidite in ACN + 2M CMPT in ACN | 8 + 6 | 30 + 900 (2'-OMe RNA) 30 + 600 (DNA) |
| 3 | capping 1 | 5% Pac$_2$O in THF/2,6-lutidine | 30 | 60 |
| 4 | capping 2 | 5% Pac$_2$O in THF/2,6-lutidine + 16% NMI in THF | 30 | 60 |
| 5 | sulfurization | 0.3M S-(2-cyanoethyl) methanethiosulfonate | 15 + 3 × 120 + 3 × 4 | 60 + 300 |

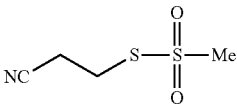

in ACN/BSTFA

Example 59. General IEX-HPLC Method for the Analysis of Crude and Purified DMT Off RNA Oligonucleotides Buffer A: 20 mM sodium phosphate, pH 11.0
Buffer B: 20 mM sodium phosphate, 1 M NaBr, pH 11.0
Column: DIONEX, DNAPac, PA-100, Analytical, 4.0×250 mm
Column temperature=60° C.
Signal monitored at 254 and 280 nm
Gradient Used:

| Time (min) | Flow (mL/min) | % A | % B | Curve |
|---|---|---|---|---|
| Initial | | 95 | 5 | |
| 3 | 1 | 95 | 5 | 1 |
| 23 | 1 | 20 | 80 | 6 |
| 25 | 1 | 5 | 95 | 6 |
| 25.5 | 1 | 95 | 5 | 6 |
| 30 | 1 | 95 | 5 | 1 |

Example 60. General UPLC-LCMS Method for the Analysis of Purified DMT Off RNA Oligonucleotides Buffer A: 15 mM TEA, 400 mM HFIP, Water
Buffer B: 50:50 Buffer A/Methanol
Column: UPLC@OST C$_{18}$ 1.7 µm, 2.1×500 mm
Column temperature=50° C.
Gradient Used:

| Time (min) | Flow (mL/min) | % A | % B | Curve |
|---|---|---|---|---|
| Initial | 0.2 | 95 | 5 | |
| 10 | 0.2 | 35 | 65 | 6 |
| 12 | 0.2 | 5 | 95 | 6 |
| 12.5 | 0.2 | 95 | 5 | 6 |
| 15 | 0.2 | 95 | 5 | 1 |

Example 61. General IEX-HPLC Method for the Purification of Crude DMTr Off RNA Oligonucleotides Buffer A: 20 mM sodium phosphate, pH 8.5
Buffer B: 20 mM sodium phosphate, 1 M NaBr, pH 8.5
Column: Empty column Waters AP-2 (Waters), custom in-house packed with Source 15Q support (GE Healthcare). The same purification column was used for the different stereopure oligonucleotides.
Instrument: Waters HPLC unit equipped with the 2525 binary gradient module, the 2487 dual absorbance detector and the 20 mL Flex injector (Waters).
Buffer heater temperature set=70° C.
Signal monitored at 254 nm and 280 nm
Fractions volume: 4.5 mL
Gradient Used:

| Time (min) | Flow (mL/min) | % A | % B | Curve |
|---|---|---|---|---|
| Initial | | 100 | 0 | |
| 10 | 10 | 100 | 0 | 1 |
| 25 | 10 | 80 | 20 | 6 |
| 85 | 10 | 67.5 | 32.5 | 6 |
| 95 | 10 | 67.5 | 32.5 | 1 |
| 155 | 10 | 55 | 45 | 6 |
| 165 | 10 | 0 | 100 | 6 |
| 170 | 10 | 100 | 0 | 6 |
| 180 | 10 | 100 | 0 | 1 |

Collected fractions were individually analyzed by analytical IEX-HPLC using the analytical conditions and gradient described above. Pure fractions were pooled in order to provide purified material of 95% and above purity as determined by the 254 nm UV absorbance profiles.

Example 62. General RP-Sep-Pak Method for the Desalting of Purified RNA Oligonucleotides The solution of pooled pure fractions was loaded on a Sep-Pak cartridge (Waters, Sep-Pak Vac 35 cc (10 g) C$_{18}$ Cartridges) pre-conditioned with water. After loading of the sample (100 mL), the cartridge was washed with milli Q water (50 mL) to remove all salt and then washed with 50% ACN/water to elute the full length desalted RNA oligonucleotide. The collected solution was concentrated in vacuo to a volume of 5 mL and lyophilized from water.

Example 63: Preparation of Double Stranded siRNA Agents Using Chirally Controlled Oligonucleotide Strands The present Example describes preparation of double stranded siRNA agents by thermal annealing of chirally controlled oligonucleotide strands as described above.

Each RNA strand was mixed with its complementary RNA strand in equimolar concentration of 10 µM in 1×PBS. Total 0.5 mL solution was prepared for each duplex and the mixture was heated at 90° C. for 2 min and was allowed to cool down over the course of several hours. The mixtures were then stored at 4° C. Physico-chemical properties of the utilized RNA strands are presented below in Table E-26.

TABLE E-26

| duplex ID | sequence | sequence ID | stereo architecture | Calc MW | Found MW |
|---|---|---|---|---|---|
| ONT D-1 | S | ONT-116 | Stereorandom diastereomixture | 6735.4 | 6734.9 |
|  | AS1 | ONT-114 | Stereorandom diastereomixture | 6805.4 | 6805.2 |
| ONT D-2 | S | ONT-107 | Sp | 6735.4 | 6736.6 |
|  | AS1 | ONT-109 | Sp | 6805.4 | 6801.6 |
| ONT D-3 | S | ONT-106 | Rp | 6735.4 | 6731.8 |
|  | AS1 | ONT-109 | Sp | 6805.4 | 6801.6 |
| ONT D-4 | S | ONT-107 | Sp | 6735.4 | 6736.6 |
|  | AS1 | ONT-108 | Rp | 6805.4 | 6799.2 |
| ONT D-5 | S | ONT-106 | Rp | 6735.4 | 6731.8 |
|  | AS1 | ONT-108 | Rp | 6805.4 | 6799.2 |
| ONT D-7 | S | ONT-116 | Stereorandom diastereomixture | 6735.4 | 6734.9 |
|  | AS2 | ONT-115 | Stereorandom diastereomixture | 6835.5 | 6835.2 |
| ONT D-8 | S | ONT-106 | Rp | 6735.4 | 6731.8 |
|  | AS2 | ONT-110 | Rp, Rp | 6835.5 | 6832.3 |
| ONT D-9 | S | ONT-107 | Sp | 6735.4 | 6736.6 |
|  | AS2 | ONT-110 | Rp, Rp | 6835.5 | 6832.2 |
| ONT D-10 | S | ONT-106 | Rp | 6735.4 | 6731.8 |
|  | AS2 | ONT-111 | Sp, Rp | 6835.5 | 6832.4 |
| ONT D-11 | S | ONT-107 | Sp | 6735.4 | 6736.6 |
|  | AS2 | ONT-111 | Sp, Rp | 6835.5 | 6832.4 |
| ONT D-12 | S | ONT-106 | Rp | 6735.4 | 6731.8 |
|  | AS2 | ONT-112 | Sp, Sp | 6835.5 | 6836.2 |
| ONT D-13 | S | ONT-107 | Sp | 6735.4 | 6736.6 |
|  | AS2 | ONT-112 | Sp, Sp | 6835.5 | 6836.2 |
| ONT D-14 | S | ONT-106 | Rp | 6735.4 | 6731.8 |
|  | AS2 | ONT-113 | Rp, Sp | 6835.5 | 6834.6 |
| ONT D-15 | S | ONT-107 | Sp | 6735.4 | 6736.6 |
|  | AS2 | ONT-113 | Rp, Sp | 6835.5 | 6834.6 |

Oligonucleotide sequences used, human PCSK9 siRNA: Sense strand (S) 5'-uucuAGAccuGuuuuGcuudTsdT-3' (SEQ ID NO: 121); Antisense strand 1 (AS1) 5'-AAGcAAAAcA-GGUCuAGAAdTsdT-3' (SEQ ID NO: 122); Antisense strand 2 (AS2) 5'-asAGcAAAAcAGGUCuAGAAdTsdT-3' (SEQ ID NO: 123). Upper case nucleotides: RNA, lower case nucleotides 2'-OMe, d=2'-deoxy, s=phosphorothioate.

Stereo architecture describes the stereoisomer nature (Rp/Sp absolute configuration) of each phosphorus atom in a given phosphorothioate linkage of the oligonucleotide. Found molecular weight (MW) values were obtained using the corresponding analytical methods for the purified compounds (described above).

Figure 51:
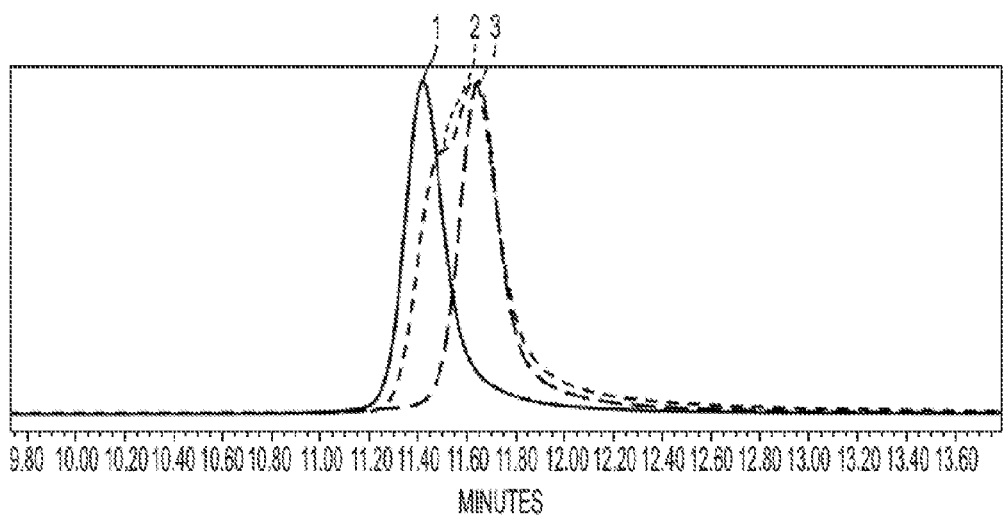
FIG. 51. Overlay of RP-HPLC traces of purified DMT off oligonucleotide: ONT-108, ONT-109, and ONT-114.

FIG. 51 shows overlays of IEX-HPLC profiles showing difference in retention times between stereopure RNA oligonucleotides.

| Curve # | Oligonucleotide |
|---|---|
| 1 | ONT-109 (Sp) |
| 2 | ONT-114 (diastereomixture) |
| 3 | ONT-108 (Rp) |

Figure 52:
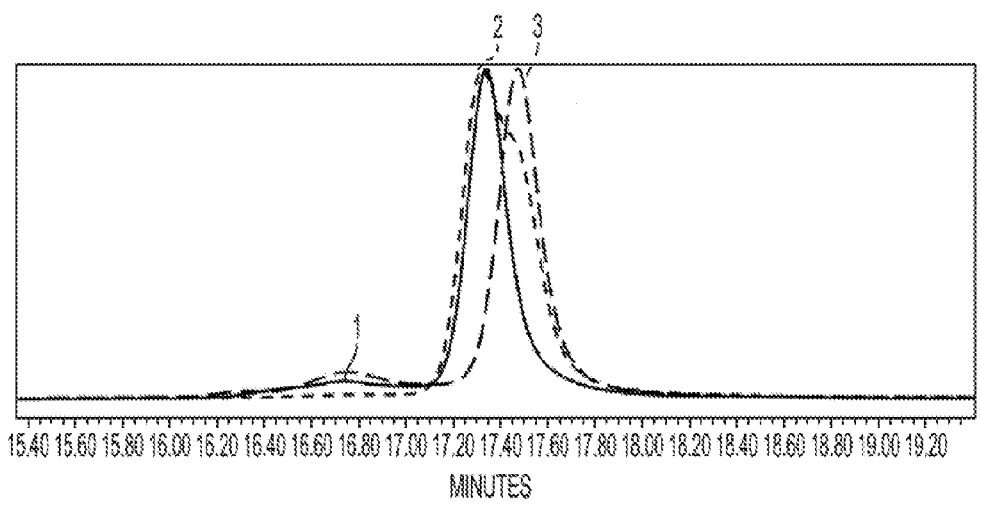
FIG. 52. Overlay of RP-HPLC traces of purified DMT off oligonucleotide: ONT-106, ONT-107, and ONT-114.

FIG. 52 shows overlays of IEX-HPLC profiles showing difference in retention times between stereopure RNA oligonucleotides.

| Curve # | Oligonucleotide |
|---|---|
| 1 | ONT-109 (Rp) |
| 2 | ONT-114 (diastereomixture) |
| 3 | ONT-107 (Sp) |

In addition to the above specifically exemplified, prepared chirally controlled siRNA oligonucleotides, the present invention provides for preparation of siRNA duplexes having several chiral phosphorothioate internucleotide linkages, and full chiral phosphorothioate internucleotide linkages.

For example, in accordance with the present invention, multiple chiral phosphorothioate linkages are introduced inside a RNA oligonucleotide by using the appropriate chiral RNA 3'-phosphoramidites, having suitable 2'-OH protecting groups, such as 2'-O-PivOM (Debart et al., *Chem. Eur. J,* 2008, 14, 9135), 2'-O—CEM (Ohgi et al., *Org. Lett.,* 2005, 7, 7913; Wada et al., *J. Org. Chem.,* 2012, 77, 7913), 2'-O-TOM (Pitsch et al., *Helv. Chim. Acta,* 2001, 84, 3773) or 2'-O-TC (Dellinger et al., *J. Am. Chem. Soc.,* 2011, 133, 11540). Each of the following Human PCSK9 siRNA Sense Strands having several chiral phosphorothioate internucleotide linkages and full chiral phosphorothioate internucleotide linkages can be prepared in accordance with the present invention:

|  | SEQ ID NO: | PCSK9 siRNA Sense Strands |
|---|---|---|
| PCSK9 (1) | 121 | (All (Sp))-ususcsusAsGsAscscsusGsusususuGscsususdTsdT |
| PCSK9 (2) | 121 | (All (Rp))-ususcsusAsGsAscscsusGsusususuGscsususdTsdT |
| PCSK9 (3) | 121 | (All (Sp))-usucuAsGsAsccuGsuuuuGscuusdTsdT |
| PCSK9 (4) | 121 | (All (Rp))-usucuAsGsAsccuGsuuuuGscuusdTsdT |
| PCSK9 (5) | 121 | (Rp, Sp, Rp, Sp, Rp, Sp, Rp, Sp, Rp, Sp, Rp, Sp, Rp, Sp, Rp, Sp, Rp, Sp, Rp, Sp)-ususcsusAsGsAscscsusGsusususuGscsususdTsdT |
| PCSK9 (6) | 121 | (Sp, Rp, Sp, Rp, Sp, Rp, Sp, Rp, Sp, Rp, Sp, Rp, Sp, Rp, Sp, Rp, Sp, Rp, Sp, Rp)-ususcsusAsGsAscscsusGsusususuGscsususdTsdT |

NOTE:
lower case letters represent 2'-OMe RNA residues; capital letters represent RNA residues; d = 2'-deoxy residues; and "s" indicates a phosphorothioate moiety.

Synthesis examples for Human PCSK9 siRNA Antisense Strands having several chiral phosphorothioate internucleotide linkages and full chiral phosphorothioate internucleotide linkages.

|  | SEQ ID NO: | Human PCSK9 siRNA Antisense Strands |
|---|---|---|
| PCSK9 (7) | 122 | (All (Rp))-AsAsGscsAsAsAsAscsAsGsGsUsCsusAsGsAsAsdTsdT |
| PCSK9 (8) | 122 | (All (Sp))-AsAsGscsAsAsAsAscsAsGsGsUsCsusAsGsAsAsdTsdT |
| PCSK9 (9) | 122 | (All (Rp))-AsAGcAAAAcsAsGsGsUsCsusAsGsAsAsdTsdT |
| PCSK9 (10) | 122 | (All (Sp))-AsAGcAAAAcsAsGsGsUsCsusAsGsAsAsdTsdT |
| PCSK9 (11) | 122 | (All (Rp))-AAsGscsAsAsAsAscAGGUCuAGAAdTsdT |
| PCSK9 (12) | 122 | (All (Sp))-AAsGscsAsAsAsAscAGGUCuAGAAdTsdT |
| PCSK9 (13) | 122 | (All (Rp))-AsAsGscAsAsAsAscAsGsGsUsCsuAsGsAsAsdTsdT |
| PCSK9 (14) | 122 | (All (Sp))-AsAsGscAsAsAsAscAsGsGsUsCsuAsGsAsAsdTsdT |
| PCSK9 (15) | 122 | (All (Rp))-AsAGcAAAsAscAsGsGsUsCsusAsGsAsAsdTsdT |
| PCSK9 (16) | 122 | (All (Sp))-AsAGcAAAsAscAsGsGsUsCsusAsGsAsAsdTsdT |
| PCSK9 (17) | 122 | (Rp, Sp, Rp, Sp, Rp, Sp, Rp, Sp, Rp, Sp, Rp, Sp, Rp, Sp)-AsAGcAAAsAscAsGsGsUsCsusAsGsAsAsdTsdT |
| PCSK9 (18) | 122 | (Sp, Rp, Sp, Rp, Sp, Rp, Sp, Rp, Sp, Rp, Sp, Rp, Sp, Rp)-AsAGcAAAsAscAsGsGsUsCsusAsGsAsAsdTsdT |

NOTE:
lower case letters represent 2'-OMe RNA residues; capital letters represent RNA residues; d = 2'-deoxy residues; and "s" indicates a phosphorothioate moiety.

Alternatively or additionally, the present invention provides for preparation of siRNA duplexes having several chiral phosphorothioate internucleotide linkages and full chiral phosphorothioate internucleotide linkages and fully modified ribose moieties.

For example, in certain embodiments, multiple chiral phosphorothioate linkages are introduced inside a fully ribose-modified RNA oligonucleotide by using the appropriate chiral RNA 3'-phosphoramidites, having the corresponding desired ribose 2'-chemical modification, such as 2'-deoxy-2'-fluoro (2'-F) or 2'-O-methyl (2'-OMe). To give but a few examples, each of the following Human PCSK9 siRNA fully modified 2'-F/2'-OMe Sense Strands having several chiral phosphorothioate internucleotide linkages and full chiral phosphorothioate internucleotide linkages, can be prepared.

|  | SEQ ID NO: | Human PCSK9 siRNA fully modified 2'-F/2'-OMe Sense Strands |
|---|---|---|
| PCSK9 (19) | 121 | (All (Rp))-UfsusCfsusAfsgsAfscsCfsusGfsusUfsusUfsgsCfsusUfsdTsdT |
| PCSK9 (20) | 121 | (All (Sp))-UfsusCfsusAfsgsAfscsCfsusGfsusUfsusUfsgsCfsusUfsdTsdT |
| PCSK9 (21) | 121 | (All (Rp))-UfsuCfsuAfsgAfscCfsuGfsuUfsuUfsgCfsuUfsdTsdT |
| PCSK9 (22) | 121 | (All (Sp))-UfsuCfsuAfsgAfscCfsuGfsuUfsuUfsgCfsuUfsdTsdT |
| PCSK9 (23) | 121 | (Rp, Sp, Rp, Sp, Rp, Sp, Rp, Sp, Rp, Sp, Rp, Sp, Rp, Sp, Rp, Sp, Rp, Sp, Rp, Sp)-UfsusCfsusAfsgsAfscsCfsusGfsusUfsusUfsgsCfsusUfsdTsdT |
| PCSK9 (24) | 121 | (Sp, Rp, Sp, Rp, Sp, Rp, Sp, Rp, Sp, Rp, Sp, Rp, Sp, Rp, Sp, Rp, Sp, Rp, Sp, Rp)-UfsusCfsusAfsgsAfscsCfsusGfsusUfsusUfsgsCfsusUfsdTsdT |

NOTE:
lower case letters represent 2'-OMe RNA residues; capital letters represent 2'-F RNA residues; d = 2'-deoxy residues; and "s" indicates a phosphorothioate moiety.

Synthesis examples for Human PCSK9 siRNA fully modified 2'-F/2'-OMe Antisense Strands having several chiral phosphorothioate internucleotide linkages and full chiral phosphorothioate internucleotide linkages.

effects, immunestimulation, duration of action, pharmacokinetics, etc. may be modulated and influenced by the stereochemistry of the chiral phosphorothioate backbone linkages, as described herein.

|  | SEQ ID NO: | Human PCSK9 siRNA fully modified 2'-F/2'-OMe Antisense Strands |
|---|---|---|
| PCSK9 (25) | 122 | (All (Rp))-asAfsgsCfsasAfsasAfscsAfsgsGfsusCfsusAfsgsAfsasdTsdT |
| PCSK9 (26) | 122 | (All (Sp))-asAfsgsCfsasAfsasAfscsAfsgsGfsusCfsusAfsgsAfsasdTsdT |
| PCSK9 (27) | 122 | (All (Rp))-asAfgCfaAfaAfcsAfsgsGfsusCfsusAfsgsAfsasdTsdT |
| PCSK9 (28) | 122 | (All (Sp))-asAfgCfaAfaAfcsAfsgsGfsusCfsusAfsgsAfsasdTsdT |
| PCSK9 (29) | 122 | (All (Rp))-asAfsgCfsaAfsaAfscAfsgGfsuCfsuAfsgAfsadTsdT |
| PCSK9 (30) | 122 | (All (Sp))-asAfsgCfsaAfsaAfscAfsgGfsuCfsuAfsgAfsadTsdT |
| PCSK9 (31) | 122 | (Rp, Sp, Rp, Sp, Rp, Sp, Rp, Sp, Rp, Sp, Rp, Sp, Rp, Sp)-asAfgCfaAfasAfscAfsgsGfsusCfsusAfsgsAfsasdTsdT |
| PCSK9 (32) | 122 | (Sp, Rp, Sp, Rp, Sp, Rp, Sp, Rp, Sp, Rp, Sp, Rp, Sp, Rp)-asAfgCfaAfasAfscAfsgsGfsusCfsusAfsgsAfsasdTsdT |

NOTE:
lower case letters represent 2'-OMe RNA residues; capital letters represent 2'-F RNA residues; d = 2'-deoxy residues; and "s" indicates a phosphorothioate moiety.

To assemble duplexes, RNA strand thermal annealing and preparation of siRNA duplexes is performed. Specifically, each RNA strand is mixed with its complementary RNA strand in equimolar concentration of 10 μM in 1×PBS. Total 0.5 mL solution is prepared for each duplex and the mixture is heated at 90° C. for 2 min and is allowed to cool down over the course of several hours. The mixtures are then stored at 4° C.

Following the thermal RNA strand annealing step, all the possible siRNA duplex combinations can be prepared by annealing any of the Sense strands with any possible complementary strand of the Antisense strands.

All prepared siRNA duplexes can be evaluated in vitro for their PCSK9 gene-silencing properties, following transfection in HeLa cells or Hep3B cells (e.g., as described herein). According to the present invention, different potencies may be observed for different duplexes, e.g., that vary in number, position, and/or stereo architecture of the chiral phosphorothioate backbone linkages, and optionally also in presence, level, and or type of one or more other chemical modifications.

Any or all siRNA properties such as: nuclease resistance, cell penetration, endosomal escape, duplex thermodynamic stability, tridemnsional structure of the duplex, affinity towards the various mechanistic steps of enzyme interactions, affinity towards the target mRNA, specific off-target Example 64. Preparation of Chirally Controlled Preparations of Oligonucleotide

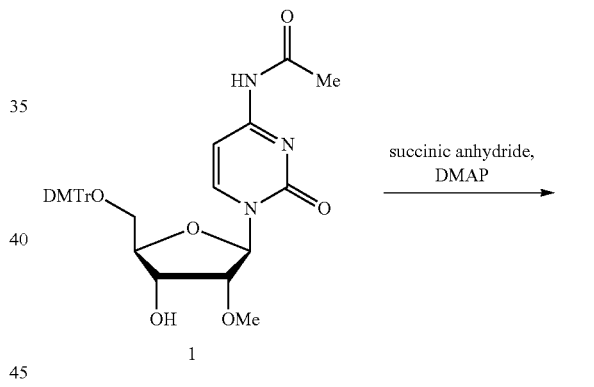

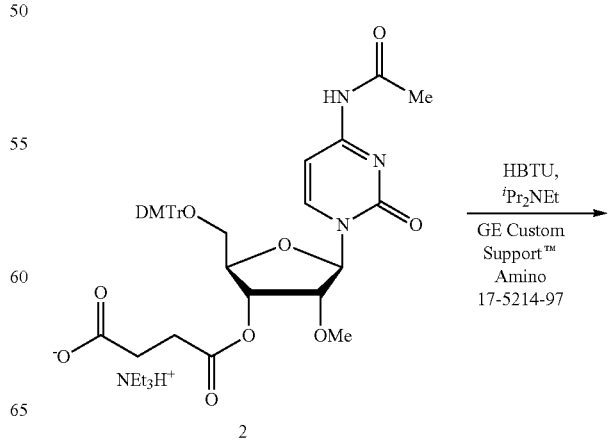

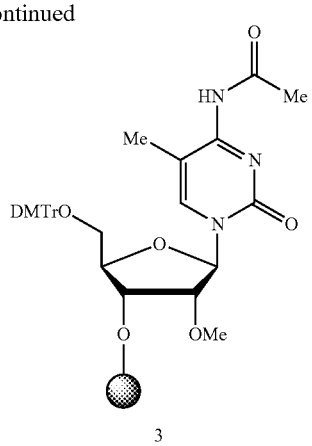

3

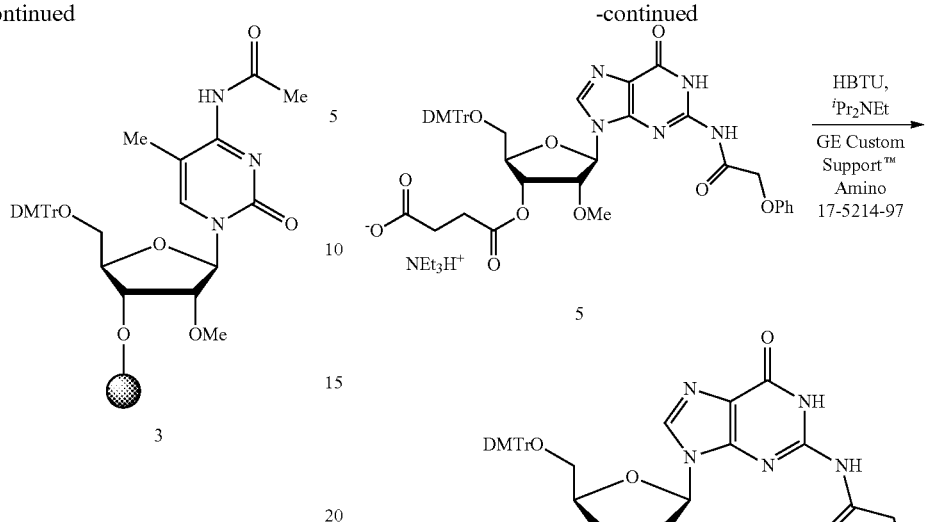

The present Example describes preparation of a variety of particular chirally controlled compositions of certain oligonucleotides described therein.

N⁴-Acetyl-5'-O-DMTr-2'-O-methylcytidine (1) (1.15 g, 1.91 mmol) was dissolved in anhydrous DCM (20 mL) and mixed with 2 equiv of succinic anhydride (0.383 g, 3.82 mmol) and 3 equiv of 4-N,N-dimethylaminopyridine (0.701 g, 5.73 mmol). The reaction was stirred under Argon at room temperature. After complete consumption of starting material as determined by TLC (1 hour), the solvents were evaporated to dryness, the crude residue was dissolved in DCM containing 1% triethylamine then purified by flash silica gel chromatography using a gradient of 0-2% of MeOH in DCM containing 2% of triethylamine. Yield of pure succinyl compound (2) after evaporation was 1.50 g, 98%. MS (ESI +ve): calc (M+H)⁺: 702.27, found: 702.34. The resulting N⁴-acetyl-5'-O-DMTr-3'-O-succinyl-2'-O-methylcytidine (2) (0.18 g, 0.22 mmol), N,N-diisopropylethylamine (0.18 mL, 0.79 mmol) and GE Custom Support™ Amino (1 g) were taken up in DMF (5 mL) then HBTU (0.10 g, 0.26 mmol) was added. The mixture was shaken for 2 h then filtered. The support was washed with DMF, MeOH and finally DCM then dried in vacuo. Trityl cation analysis (monitoring at 504 nm) showed that the loading of nucleoside on the support (3) was 180 μmol/g.

Example 65. Preparation of Chirally Controlled Preparations of Oligonucleotide

Using a procedure analogous to that described in Example 64, N²-Phenoxyacetyl-5'-O-DMTr-3'-O-succinyl-2'-O-methylguanosine (4, MS (ESI +ve): calc (M+H)⁺: 834.30, found: 834.32) was loaded onto GE Custom Support™ Amino. Trityl cation analysis (monitoring at 504 nm) showed that the loading of nucleoside on the support (6) was 140 μmol/g.

In some embodiments, oligonucleotides containing stereodefined 2'-OMe phosphorothioate triester internucleotidic linkages was synthesized on ABI 394DNA/RNA synthesizer according to the cycle summarized in Table E-27 using a 10 μmol capacity synthesis column loaded with 60 mg (10.8 and 8.4 μmol respectively) of either uncapped succinyl linked 5'-O-DMTr-2'-O-methyl-G$^{Pac}$ (6, 140 μmol/g) or 5'-O-DMTr-2'-O-methyl-C$^{Ac}$ (3, 180 μmol/g). The synthesis cycle was performed with a preliminary capping step (capping 2) and with removal of the terminal 5'-O-DMTr group. The stereospecific sulfurization steps were performed using the 0.3 M S-(2-cyanoethyl)methylthiosulfonate reagent in ACN containing BSTFA, following the coupling of the corresponding chiral phosphoramide and the two-step capping process (Table E-27).

Once the automated oligonucleotide synthesis cycle was complete, and the final 5'-O-DMTr group removed, the synthesis column was taken off the DNA/RNA synthesizer and dried under vacuum. The dried support was transferred onto an empty glass manual peptide synthesizer and 10 mL solution of 0.5 M 1,5-diazabicyclo[4.3.0]non-5-ene (DBN), 0.25 M N,O-bis(trimethylsilyl)trifluoroacetamide (BSTFA) in ACN was continuously added to the support for 5 min without stopping the flow in the manual peptide synthesizer. The support was washed by ACN and dried in vacuo. Then, the support was treated with 5% EtOH/conc NH₃ (5 mL) at 60° C. for 6 h, and left at room temperature for 12 h. The support was removed by filtration and washed with conc. NH₃. The filtrate was concentrated in vacuo then purified by IEX.

TABLE E-27

Summary for Oligonucleotide Synthesis.

| step | reaction | reagent | delivery time (sec) | wait time (sec) |
|---|---|---|---|---|
| 1 | detritylation | 3% TCA in DCM | 3 + 120 + 10 | N.A. |
| 2 | coupling | 0.15M phosphoramidite in ACN + 2M CMPT in ACN | 8 + 6 | 30 + 900 |
| 3 | capping 1 | 5% Pac$_2$O in THF/2,6-lutidine | 30 | 60 |
| 4 | capping 2 | 5% Pac$_2$O in THF/2,6-lutidine + 16% NMI in THF | 30 | 60 |
| 5 | sulfurization | 0.3M (S-cyanoethyl) methanethiosulfonate [structure: NC-CH$_2$CH$_2$-S-S(=O)$_2$-Me] in ACN/BSTFA | 15 + 3 × 4 | 120 + 3 × 60 + 300 |

Synthesis of Oligonucleotide ONT-94:   (All (Sp))-gsgsusgsgsasasgsgsc (SEQ ID NO: 124).
                                       $t_R$ (IEX-HPLC): 18.26 min. Calc MW: 3563.9;
                                       Found MW: 3562.6.

Synthesis of Oligonucleotide ONT-96:   (All (Rp))-gsgsusgsgsasasgsgsc (SEQ ID NO: 124).
                                       $t_R$ (IEX-HPLC): 18.16 min. Calc MW: 3563.9;
                                       Found MW: 3561.7.

Synthesis of Oligonucleotide ONT-98:   (Rp, Sp, Rp, Sp, Rp, Sp, Rp, Sp, Rp)-
                                       gsgsusgsgsasasgsgsc (SEQ ID NO: 124).
                                       $t_R$ (IEX-HPLC): 18.05 min. Calc MW: 3563.9;
                                       Found MW: 3562.5.

Synthesis of Oligonucleotide ONT-100:  (Sp, Rp, Sp, Rp, Sp, Rp, Sp, Rp, Sp)-
                                       gsgsusgsgsasasgsgsc (SEQ ID NO: 124).
                                       $t_R$ (IEX-HPLC): 17.86 min. Calc MW: 3563.9;
                                       Found MW: 3561.1.

Synthesis of Oligonucleotide ONT-102:  (Rp, Rp, Sp, Sp, Sp, Sp, Sp, Rp, Rp)-
                                       gsgsusgsgsasasgsgsc (SEQ ID NO: 124).
                                       $t_R$ (IEX-HPLC): 18.30 min. Calc MW: 3563.9;
                                       Found MW: 3561.3.

Synthesis of Oligonucleotide ONT-104:  (Sp, Sp, Rp, Rp, Rp, Rp, Rp, Sp, Sp)-
                                       gsgsusgsgsasasgsgsc (SEQ ID NO: 124).
                                       $t_R$ (IEX-HPLC): 17.95 min. Calc MW3563.9;
                                       Found MW: 3562.7.

Synthesis of Oligonucleotide ONT-95:   (All (Sp))-gscscsuscscsasg. $t_R$ (IEX-
                                       HPLC): 14.78 min. Calc MW: 2709.2; Found MW: 2707.4.

Synthesis of Oligonucleotide ONT-97:   (All (Rp))-gscscsuscscsasg. $t_R$ (IEX-
                                       HPLC): 15.60 min. Calc MW: 2709.2; Found MW: 2708.3.

Synthesis of Oligonucleotide ONT-99:   (Rp, Sp, Rp, Sp, Rp, Sp, Rp)-
                                       gscscsuscscsasg. $t_R$ (IEX-HPLC): 16.10 min. Calc
                                       MW: 2709.2; Found MW: 2708.0.

Synthesis of Oligonucleotide ONT-101:  (Sp, Rp, Sp, Rp, Sp, Rp, Sp)-
                                       gscscsuscscsasg. $t_R$ (IEX-HPLC): 16.23 min. Calc
                                       MW: 2709.2; Found MW: 2708.2.

Synthesis of Oligonucleotide ONT-103:  (Rp, Rp, Sp, Sp, Sp, Rp, Rp)-
                                       gscscsuscscsasg. $t_R$ (IEX-HPLC): 16.26 min. Calc
                                       MW: 2709.2; Found MW: 2707.8.

Synthesis of Oligonucleotide ONT-105:  (Sp, Sp, Rp, Rp, Rp, Sp, Sp)-
                                       gscscsuscscsasg. $t_R$ (IEX-HPLC): 16.22 min. Calc
                                       MW: 2709.2; Found MW: 2710.0.

Oligonucleotides containing stereodefined chimeric 2'-OMe phosphorothioate triester and 2'-O-MOE phosphorothioate triester internucleotidic linkages was synthesized on ABI 394DNA/RNA in an analogous fashion to those described in examples herein.

```
Synthesis of Oligonucleotide ONT-90:    (All (Rp))-
                                        G_MOE sG_MOE susG_MOE sG_MOE sasasG_MOE sG_MOE sc
                                        (SEQ ID NO: 124).
                                        t_R (IEX-HPLC): 15.35 min. Calc MW: 3828.2;
                                        Found MW: 3826.5.

Synthesis of Oligonucleotide ONT-119:   (All (Sp))-
                                        G_MOE sG_MOE susG_MOE sG_MOE sasasG_MOE sG_MOE sc
                                        (SEQ ID NO: 124).
                                        t_R (IEX-HPLC): 16.42 min. Calc MW: 3828.2;
                                        Found MW: 3827.2.

Synthesis of Oligonucleotide ONT-91:    (All (Rp))-G_MOE scscsuscscsasg. t_R (IEX-
                                        HPLC): 15.69 min. Calc MW: 2753.3; Found MW: 2751.5.

Synthesis of Oligonucleotide ONT-120:   (All (Sp))-G_MOE scscsuscscsasg. t_R (IEX-
                                        HPLC): 14.71 min. Calc MW: 2753.3; Found MW: 2751.4.
```

Example 66. General IEX-HPLC Method for the Analysis of Crude and Purified DMT Off RIPtide Oligonucleotides Buffer A: 10 mM TrisHCl, 50% ACN, pH 8.0
Buffer B: 10 mM TrisHCl, 800 mM NaClO$_4$, 50% ACN, pH 8.0
Column: DIONEX, DNAPac, PA-200, Analytical, 4.0×250 mm
Column temperature=60° C.
Signal monitored at 254 and 280 nm
Gradient Used:

| Time (min) | Flow (mL/min) | % A | % B | Curve |
|---|---|---|---|---|
| Initial |  | 95 | 5 |  |
| 2 | 1 | 95 | 5 | 1 |
| 22 | 1 | 70 | 30 | 6 |
| 25 | 1 | 5 | 95 | 6 |
| 25.5 | 1 | 95 | 5 | 6 |
| 30 | 1 | 95 | 5 | 1 |

Example 67. General UPLC-LCMS Method for the Analysis of Purified DMT Off RIPtide Oligonucleotides Buffer A: 15 mM TEA, 400 mM HFIP, Water
Buffer B: 50:50 Buffer A/Methanol
Column: UPLC@OST C$_{18}$ 1.7 µm, 2.1×500 mm
Column temperature=50° C.
Gradient Used:

| Time (min) | Flow (mL/min) | % A | % B | Curve |
|---|---|---|---|---|
| Initial | 0.2 | 80 | 20 |  |
| 2 | 0.2 | 80 | 20 | 1 |
| 22 | 0.2 | 30 | 70 | 6 |
| 25 | 0.2 | 5 | 95 | 6 |
| 25.5 | 0.2 | 80 | 20 | 6 |
| 30 | 0.2 | 80 | 20 | 1 |

Example 68. General IEX-HPLC Method for the Purification of Crude DMT Off RIPtide Oligonucleotide Buffer A: 20 mM NaOH, pH 11.0
Buffer B: 20 mM NaOH, 2.5 M NaCl, pH 11.0
Column: Empty column Waters AP-1 (Waters), custom in-house packed with Source 15Q support (GE Healthcare). The same purification column was used for the different stereopure RIPtide oligonucleotides.
Instrument: AKTA Purifier, equipped with the P-900 pump, the UPC-900 detector and a 50 mL injection SuperLoop (GE Healthcare)
Buffer heater temperature set=70° C.
Column heater tape set=70° C.
Signal monitored at 254 nm
Fractions volume: 5 mL
Gradient Used:

| Time (min) | Flow (mL/min) | % A | % B | Curve |
|---|---|---|---|---|
| Initial |  | 100 | 0 |  |
| 15 | 4 | 100 | 0 | 1 |
| 25 | 4 | 90 | 10 | 6 |
| 35 | 4 | 90 | 10 | 1 |
| 45 | 4 | 80 | 20 | 6 |
| 60 | 4 | 80 | 20 | 1 |
| 80 | 4 | 65 | 35 | 6 |
| 95 | 4 | 65 | 35 | 1 |
| 120 | 4 | 45 | 55 | 6 |
| 125 | 4 | 45 | 55 | 1 |
| 126 | 4 | 100 | 0 | 6 |
| 140 | 4 | 100 | 0 | 1 |

Collected fractions were individually analyzed by analytical IEX-HPLC using the analytical conditions and gradient described above. Pure fractions were pooled in order to provide purified material of 95% and above purity as determined by the 254 nm UV absorbance profiles.

General RP-Sep-Pak method for the desalting of purified RIPtides oligonucleotides. The solution of pooled pure fractions was loaded on a Sep-Pak cartridge (Waters, Sep-Pak Vac 35 cc (10 g) C$_{18}$ Cartridges) pre-conditioned with water. After loading of the sample (100 mL), the cartridge was washed with milli Q water (50 mL) to remove all salt and then washed with 50% ACN/water to elute the full length desalted RNA oligonucleotide. The collected solution was concentrated in vacuo to a volume of 5 mL and lyophilized from water.

A panel of stereocontrolled fully phosphorothioate modified RIPtides (8-mer or 10-mer) that bind naked hTR are investigated for the in vitro inhibition of the activity of the telomerase RNP complex. The Cy5-TRAP assay (Shay et al., *Nat. Protoc.*, 2006, 1, 1583), a variation of the TRAP (Shay et al., *Science*, 1994, 266, 2011), is used to the determine the $IC_{50}$ values for the stereocontrolled phosphorothioate RIPtides using HeLa cell extracts, according to previously reported protocols (Verdine et al., *J. Biol. Chem.*, 2012, 287, 18843).

TRAP assays are performed following previously reported protocols that use fluorescence as a quantitation system, with some modifications. Briefly, extension of a fluorescent artificial substrate by telomerase is carried out for 30 minutes at 30° C., followed by amplification with 30 PCR cycles (34° C. 30 s, 59° C. 30 s, 72° C. 1 min). The inhibitory potential of the RIPtides is initially assessed in HeLa cell extracts, in duplicate experiments, using a 600 μM-60 μM concentration range. Experiments with selected RIPtides are repeated for a concentration range of 0.06 μM-60 μM in HeLa, DU145 (prostate cancer) and HEK293 cell extracts. Several controls are used in these assays: a positive control (untreated cell lysate), negative controls (buffer only, heat inactivated and RNase treated cell extracts), and PCR amplification control (60 μM of RIPtide added after telomerase elongation and before PCR). In certain embodiments, chirally controlled RIPtide preparations show enhanced inhibition of hTR as compared with the positive control and/or enhanced inhibition of hTR as compared with the negative control; in some embodiments, some, but optionally not all RIPtides of a given sequence show such properties. In some embodiments, by "enhanced" in this context is meant enhanced by between about five-fold and about ten-fold. In some embodiments, by "enhanced" is meant at least about 1.5, 2.0, 2.5, 3.0, 3.5, 4.0, 4.5, 5.0, 5.5, 6.0, 6.5, 7.0, 7.5, 8.0, 8.5, 9.0, 9.5, or 10.0-fold.

Cell Culturing Conditions. The transformed embryonic kidney cell line HEK293 and the prostate cancer cell line DU145 are maintained in DMEM supplemented with 10% fetal bovine serum in 5% $CO_2$ at 37° C. Soluble cell extracts for TRAP assays are prepared by detergent lysis of 106 cells with 200 μL 1×CHAPS Lysis Buffer (Chemicon) as described in the manufacturer's instructions.

According to the present invention, different potencies and/or different other properties may be observed for the various stereoarchitectures of fully stereocontrolled phosphorothioate RIPtides. For instance, RIPtide properties such as: nuclease resistance, tissue accumulation, cell penetration, endosomal escape, tridemnsional structure of the RIPtide, affinity towards the target folded hTR RNA, immunestimulation, duration of action, pharmacokinetics, etc. may vary for chirally controlled RIPtide preparations that share the same sequence but differ from one another with respect to different location and/or stereochemistry of one or more chiral phosphorothioate backbone linkages.

Example 69: Chirally Controlled Oligonucleotide Compositions Show Different Activity In Vivo as Compared with Chirally Uncontrolled Compositions Having the Same Sequence The present Example compares in vivo pharmacological activity of chirally pure oligonucleotides with that observed for the "parent" stereorandom mixture (i.e., for a composition containing oligonucleotides of the same sequence as the chirally pure oligonucleotides but not displaying chiral purity, for example as a result of having been prepared via a stereorandom process). Four chirally pure oligonucleotides, each of which had a sequence complementary to that of a particular target transcript or gene encoding a protein of interest were synthesized, formulated, and administered twice per week for 5 weeks at two dose levels each, to animals expressing the target gene. Levels of encoded protein levels were quantified. In this Example, oligonucleotides having a sequence antisense to (and therefore targeting) human Apolipoprotein-B (ApoB) were used for proof-of-concept in transgenic mice expressing human ApoB.

Test Articles

Test articles were PBS alone (i.e., no oligonucleotide control) or the relevant oligonucleotide composition (i.e., Mipomersen (ONT-41), ONT-75, ONT-77, ONT-80, or ONT-81 oligonucleotides (see Example 52 for structures) were formulated in 1×PBS (diluted from 10×PBS (Life Technologies, AM9624) using nuclease-free water (Qiagen, 129115)) at 0.5 and 1 mg/mL for dosing at 5 and 10 mg/kg, respectively. Formulations were based on absolute mass with no adjustment for the active material. Oligonucleotide concentrations were confirmed by measurement with a Carry-100 UV-Vis (Agilent Technologies). Samples of all test articles were checked for endotoxin levels using a kinetic pyrochrome chromogenic endotoxin assay (Associates of Cape Cod, 1500-5, E005-5). All tested samples were found to have a lower amount of endotoxin than the 0.5 EU/ml acceptable limit.

Animals and In Vivo Procedures

Female transgenic mice (huApoB mice) expressing high plasma concentrations of human apolipoprotein B100 and lipoprotein(a) (J. Clin. Invest. 92: 3029-3037) were obtained from Taconic (strain B6SJL-Tg(APOB)1 102Sgy N20+?, model #1004-F). All animals were genotyped prior to delivery.

Mice were delivered and allowed to acclimate for at least seven days prior to study start. All mice were given regular chow and water ad libitum, and were not fasted prior to compound administration. Mice were randomized to study groups, and dosed intraperitoneally (IP) at 10 ml/kg on Days 1, 4, 8, 11, 15, 18, 22, 25, 29 and 32, based on individual mouse body weight measured prior to dosing on each dosing day. Blood was collected during the course of the study on Days 0 (day before first dose), 17, 24, 31, 38, 45, 52 and 60 by submandibular (cheek) bleed and at sacrifice on Day 66 by cardiac puncture, and then processed to serum.

Apolipoprotein B Protein Assay

ApoB protein levels in serum were measured using an ApoB Human ELISA Kit (Abcam, ab108807). Serum samples were diluted 1:20,000 and assayed per the kit recommended protocol without modifications. Automated washes were done with 30 second soak periods using an Aquamax 4000 (Molecular Devices). Reactions were stopped after 12 minute incubations with Chromogen substrate and measurements were taken with a Spectramax M5 (Molecular Devices).

Standard curves were generated by plotting the standard concentration on the x-axis and the corresponding mean 450 nm absorbance on the y-axis. The best-fit line was determined by regression analysis using log-log curve-fit. Each assay plate included a negative (PBS treated) and a positive (Mipomersen-treated) control and each mouse serum sample was assayed in 4 technical replicates.

For each sample, the mean absolute level of ApoB was normalized to the mean value for the PBS treated group, to obtain the relative level of ApoB protein expression. In one instance, an animal was excluded from the analysis as measurements deviated from the cohort mean by 2 standard deviations. Relative levels of ApoB protein expression were used for statistical analysis (Graphpad Prism) by 2-way ANOVA followed by Newman-Keuls post-hoc test.

Results

Figure 40:
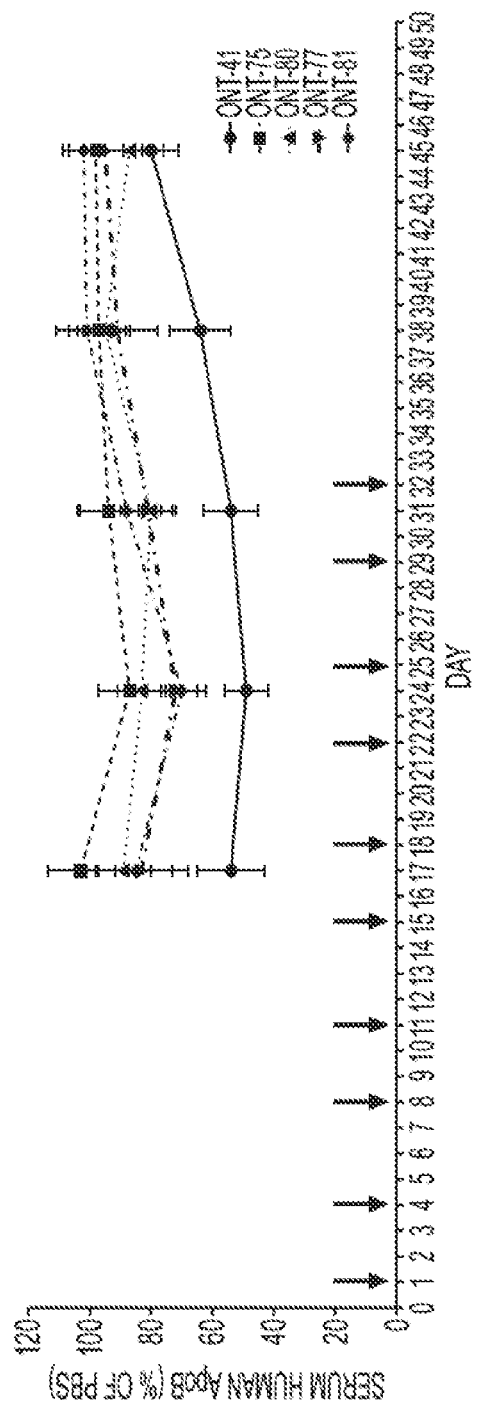
FIG. 40. Graphical representation of timecourse of serum human apolipoprotein B protein levels relative to PBS after 5 mg/kg stereoisomer or mipomersen IP dosing in huApoB mice for ONT-41, ONT-75, ONT-80, ONT-77, and ONT-81. A downward arrow indicates dosing days.
Figure 41:
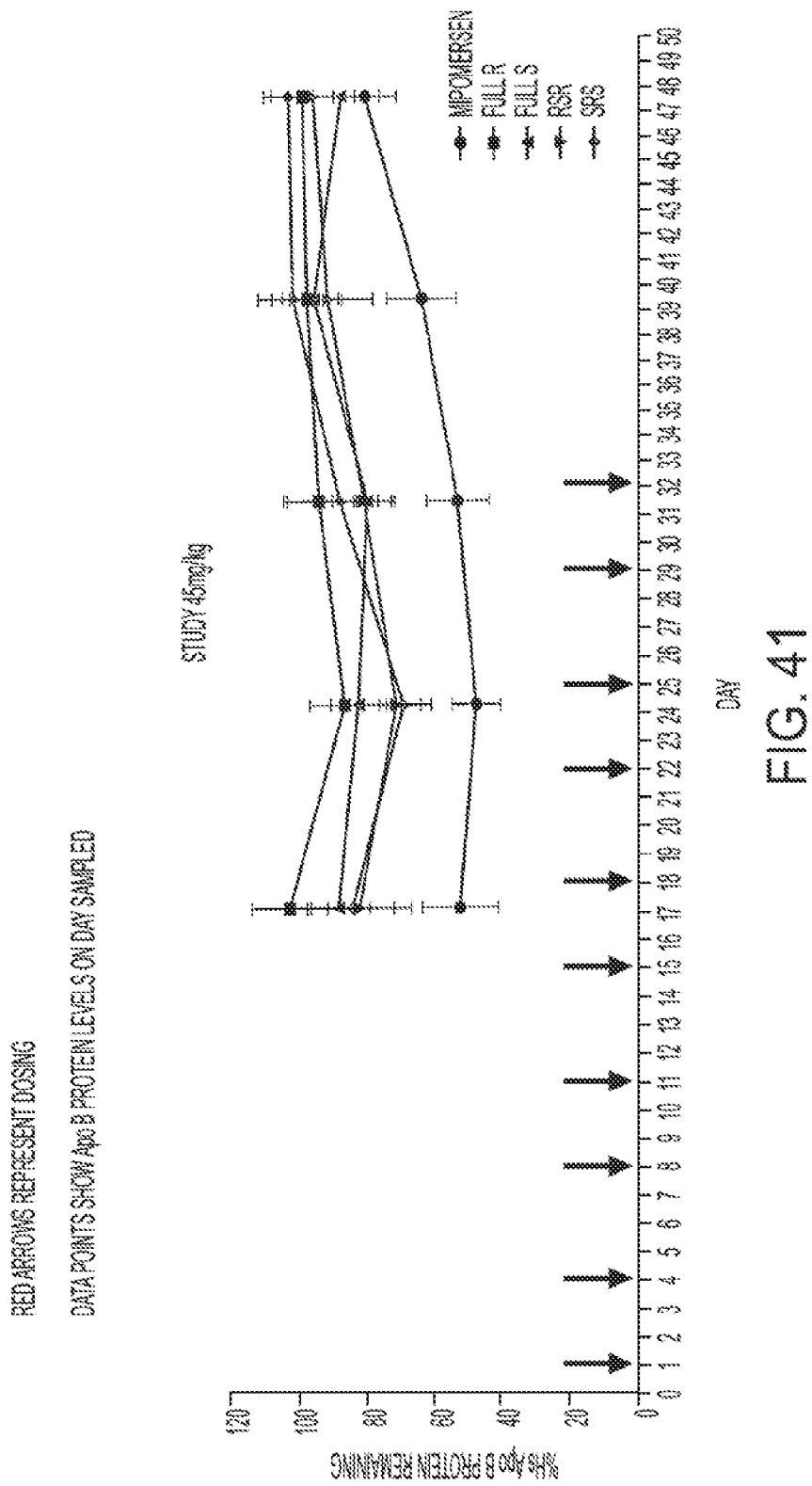
FIG. 41. Graphical representation of timecourse of serum human apolipoprotein B protein levels relative to PBS after 5 mg/kg stereoisomer or mipomersen IP dosing in huApoB mice for mipomersen, "full R" mipomersen, "full S" mipomersen, "RSR" mipomersen, and "SRS" mipomersen. A downward arrow indicates dosing days.
Figure 42:
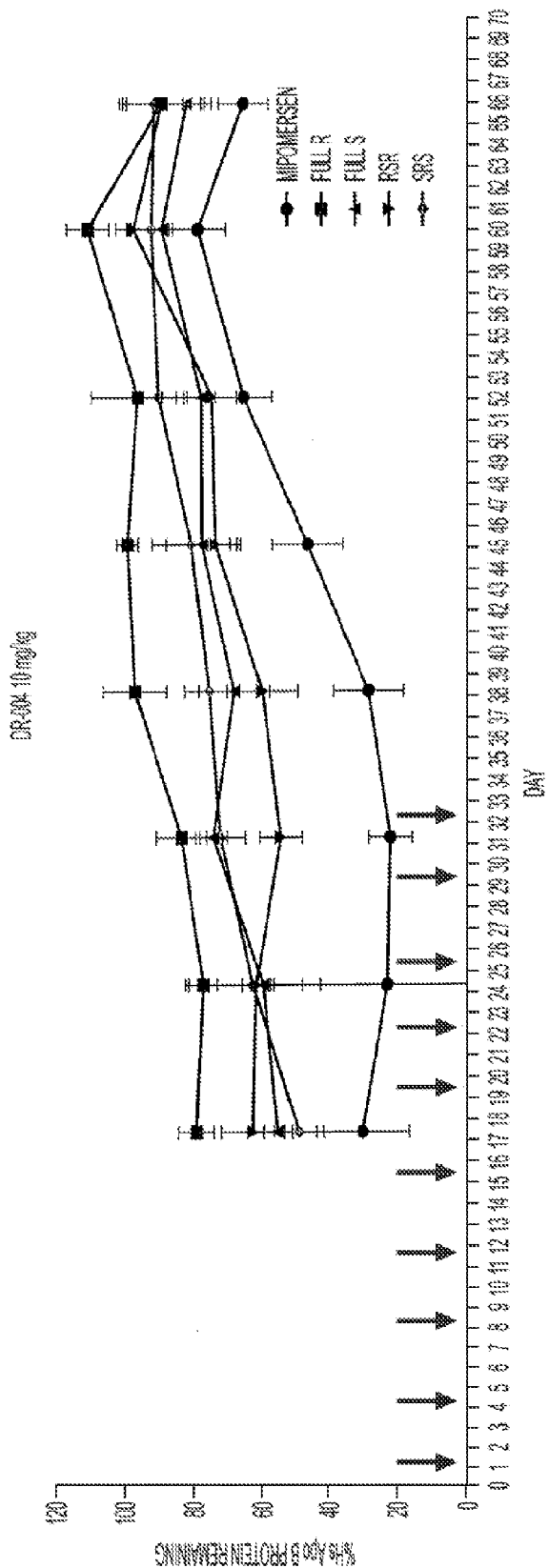
FIG. 42. Graphical representation of timecourse of serum human apolipoprotein B protein levels relative to PBS after 10 mg/kg stereoisomer or mipomersen IP dosing in huApoB mice for mipomersen, "full R" mipomersen, "full S" mipomersen, "RSR" mipomersen, and "SRS" mipomersen. A downward arrow indicates dosing days.
Figure 43:
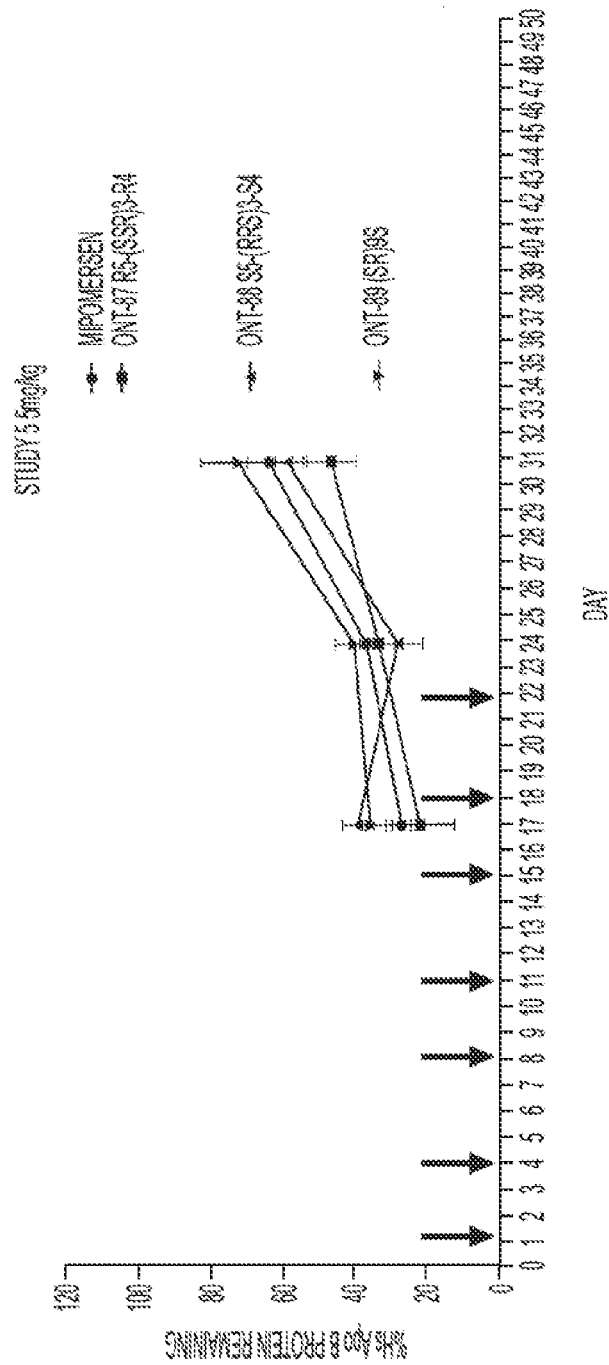
FIG. 43. Graphical representation of timecourse of serum human apolipoprotein B protein levels relative to PBS after 5 mg/kg stereoisomer or mipomersen IP dosing in huApoB mice for mipomersen, ONT-87, ONT-88, and ONT-89. A downward arrow indicates dosing days.
Figure 44:
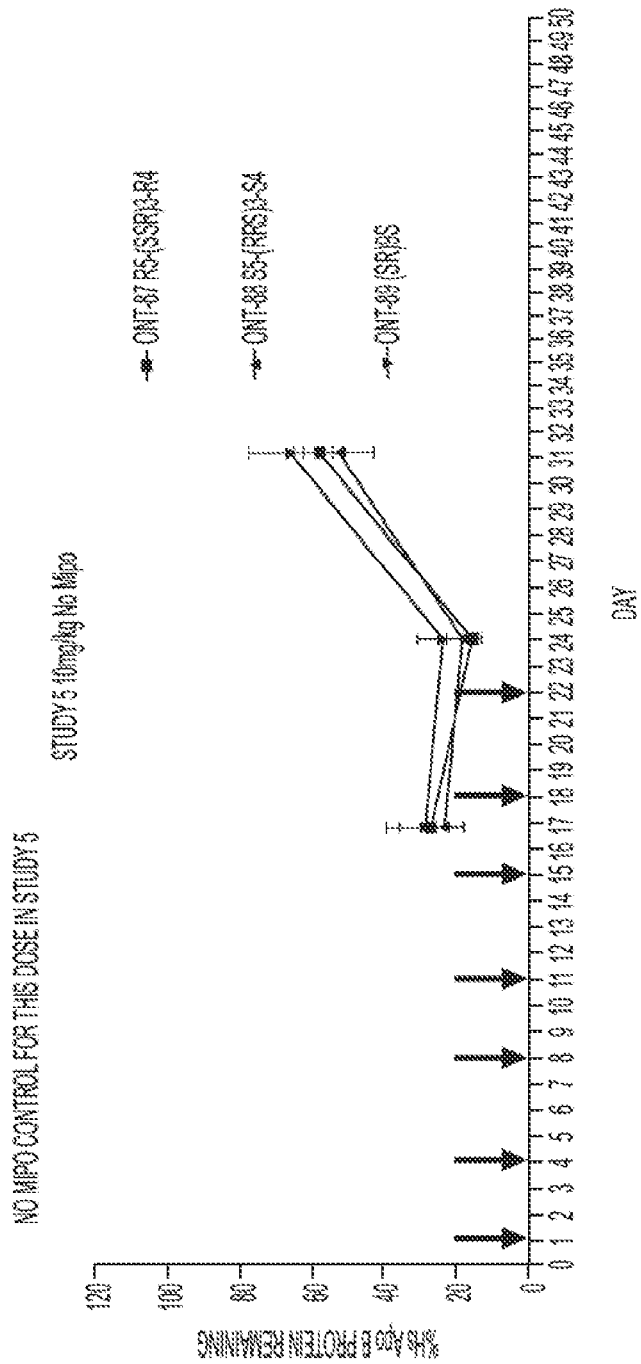
FIG. 44. Graphical representation of timecourse of serum human apolipoprotein B protein levels relative to PBS after 10 mg/kg stereoisomer or mipomersen IP dosing in huApoB mice for ONT-87, ONT-88, and ONT-89. A downward arrow indicates dosing days.

The results are shown in Table E-28a and FIG. 40. Relative to PBS, 5 mg/kg IP ONT-75 resulted in significant reductions of serum ApoB protein levels on day 24 of the study, to 87% ($p<0.05$). Relative to PBS, 5 mg/kg IP ONT-77 resulted in significant reductions of serum ApoB protein levels on days 24, and 31 of the study, to 72% ($p<0.0001$), 81% ($p<0.05$) of control levels, respectively. Relative to PBS, 5 mg/kg IP ONT-80 resulted in significant reductions of serum ApoB protein levels on days 24 and 31 of the study, to 83% ($p<0.05$), 80% ($p<0.05$) of control levels, respectively. Relative to PBS, 5 mg/kg IP ONT-81 resulted in significant reductions of serum ApoB protein levels on days 17 and 24 of the study, to 85% ($p<0.05$), 70% ($p<0.0001$) of control levels, respectively.

day 45 ($p>0.05$) of the study. Compared with 5 mg/kg IP Mipomersen, ONT-81 administered with the same dosing paradigm resulted in significantly less reduction of serum ApoB protein levels on days 17, 31 and 38 ($p<0.0001$), 24 ($p<0.001$) and 45 ($p<0.01$) of the study. FIG. 40 shows the timecourse of Serum Human Apolipoprotein B protein levels relative to PBS after 5 mg/kg stereoisomer or mipomersen IP dosing in huApoB mice. Downward arrows indicate dosing days. Group means normalized to the PBS control group are shown, where each groups comprised 4-5 animals. Error bars represent standard deviations.

Figure 53:
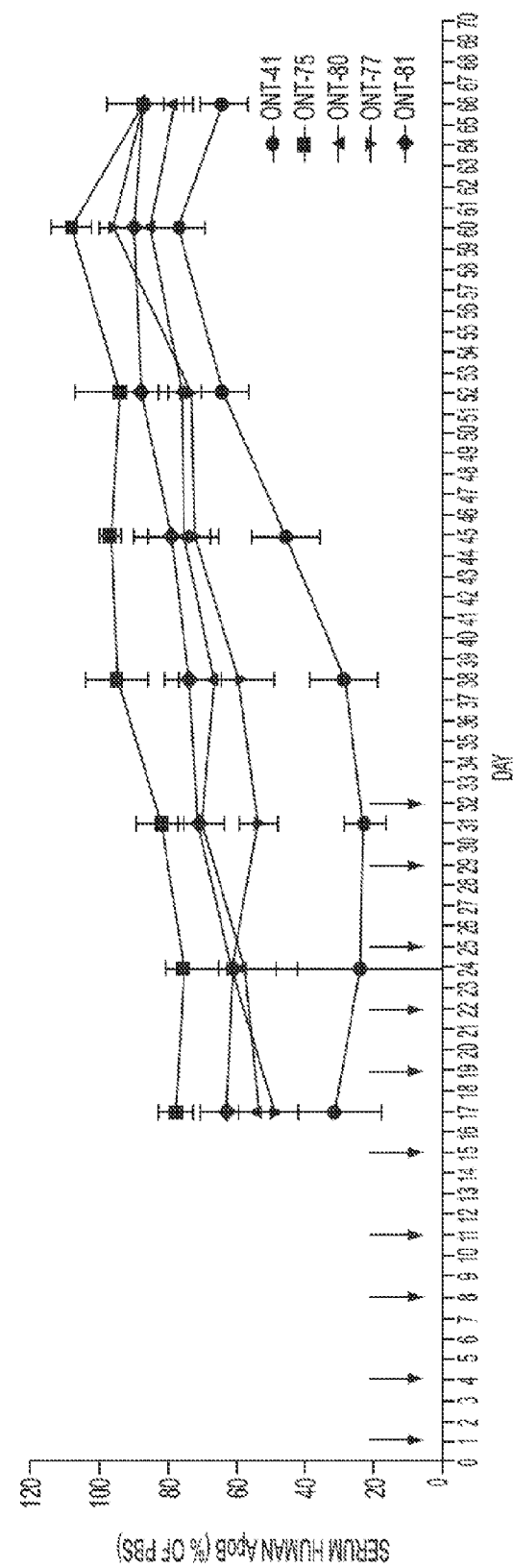
FIG. 53. Graphical representation of timecourse of serum human apolipoprotein B protein levels relative to PBS after 10 mg/kg stereoisomer or mipomersen IP dosing in huApoB mice. A downward arrow indicates dosing days.

The results of the 10 mg/kg dosing paradigm are shown in Table E-28b and FIG. 53. Relative to PBS, 10 mg/kg IP ONT-75 resulted in significant reductions of serum ApoB protein levels on days 17, 24 and 38 of the study, to 78% ($p<0.0001$), 76% ($p<0.0001$) and 82% ($p<0.001$), respectively. Relative to PBS, 10 mg/kg IP ONT-77 resulted in significant reductions of serum ApoB protein levels on days 17, 24, 31, 38, 45 and 52 of the study, to 62% ($p<0.0001$), 61% ($p<0.0001$), 54% ($p<0.0001$), 59% ($p<0.0001$), 72% ($p<0.0001$), and 73% ($p<0.0001$) of control levels, respec- TABLE E-28a Serum Human Apolipoprotein B Levels Relative to PBS After Multiple IP Doses of 5 mg/kg Stereoisomer or Mipomersen in huApoB Mice (N = 4-5]

| | Day | | | | |
|---|---|---|---|---|---|
| Sample | 17 | 24 | 31 | 38 | 45 |
| PBS | 100 ± 9 | 100 ± 9 | 100 ± 9 | 100 ± 11 | 100 ± 9 |
| ONT-41 | 54 ± 11 | 49 ± 7 | 54 ± 9 | 64 ± 10 | 80 ± 9 |
| ONT-75 | $103^d$ ± 11 | $87^{dw}$ ± 10 | $94^d$ ± 10 | $97^d$ ± 10 | $98^a$ ± 9 |
| ONT-77 | $83^d$ ± 15 | $72^{cz}$ ± 10 | $81^{dw}$ ± 9 | $91^d$ ± 13 | $95^a$ ± 12 |
| ONT-80 | $89^d$ ± 9 | $83^{dw}$ ± 8 | $80^{dw}$ ± 3 | $95^d$ ± 7 | 87 ± 11 |
| ONT-81 | $85^{dw}$ ± 12 | $70^{cz}$ ± 5 | $88^d$ ± 15 | $101^d$ ± 10 | $102^b$ ± 7 |

[a]Statistically different from the Mipomersen control group (ONT-41), with p < 0.05 (2-way ANOVA with Newman-Keuls post-hoc test)

[b]Statistically different from the Mipomersen control group (OAT-41), with p < 0.01 (2-way ANOVA with Newman-Keuls post-hoc test)

[c]Statistically different from the Mipomersen control group (ONT-41), with p < 0.001 (2-way ANOVA with Newman-Keuls post-hoc test)

[d]Statistically different from the Mipomersen control group (OAT-41), with p < 0.0001 (2-way ANOVA with Newman-Keuls post-hoc test)

[w]Statistically different from the PBS control group, with p < 0.5 (2-way ANOVA with Newman-Keuls post-hoc test)

[x]Statistically different from the PBS control group, with p < 0.01 (2-way ANOVA with Newman-Keuls post-hoc test)

[y]Statistically different from the PBS control group, with p < 0.001(2-way ANOVA with Newman-Keuls post-hoc test)

zStatistically different from the PBS control group, with p < 0.0001 (2-way ANOVA with Newman-Keuls post-hoc test)

Compared with 5 mg/kg IP Mipomersen, ONT-75 administered with the same dosing paradigm resulted in significantly less reduction of serum ApoB protein levels on days 17, 24, 31 and 38 ($p<0.0001$), and 45 ($p<0.05$) of the study. Compared with 5 mg/kg IP Mipomersen, ONT-77 administered with the same dosing paradigm resulted in significantly less reduction of serum ApoB protein levels on days 17, 31 and 38 ($p<0.0001$), 24 ($p<0.001$) and 45 ($p<0.05$) of the study. Compared with 5 mg/kg IP Mipomersen, ONT-80 administered with the same dosing paradigm resulted in significantly less reduction of serum ApoB protein levels on days 17, 24, 31 and 38 ($p<0.0001$), but was not different on tively. Relative to PBS, 10 mg/kg IP ONT-80 resulted in significant reductions of serum ApoB protein levels on days 17, 24, 31, 38, 45, 52 and 66 of the study, to 55% ($p<0.0001$), 59% ($p<0.0001$), 73% ($p<0.0001$), 67% ($p<0.0001$), 76% ($p<0.0001$), 76% ($p<0.0001$), and 80% ($p<0.01$) of control levels, respectively. Relative to PBS, 10 mg/kg IP ONT-81 resulted in significant reductions of serum ApoB protein levels on days 17, 24, 31, 38 and 45 of the study, to 49% ($p<0.0001$), 62% ($p<0.0001$), 71% ($p<0.0001$), 74% ($p<0.0001$) and 79% ($p<0.001$) of control levels, respectively.

TABLE E-28b

Serum Human Apolipoprotein B Levels Relative to PBS After
Multiple IP Doses of 10 mg/kg Stereoisomer (ONT-75, -77, -80 or -81) or Mipomersen in
huApoB Mice (N = 4-5)

| Sample | Day | | | | | | | |
|---|---|---|---|---|---|---|---|---|
| | 17 | 24 | 31 | 38 | 45 | 52 | 60 | 66 |
| PBS | 100 ± 11 | 100 ± 9 | 100 ± 17 | 100 ± 11 | 100 ± 7 | 100 ± 7 | 100 ± 9 | 100 ± 7 |
| ONT-41 | 31 ± 13 | 24 ± 24 | 23 ± 6 | 29 ± 10 | 46 ± 10 | 64 ± 8 | 77 ± 8 | 64 ± 7 |
| ONT-75 | $78^{dz} \pm 5$ | $76^{dz} \pm 4$ | $82^{dy} \pm 7$ | $95^{d} \pm 9$ | $97^{d} \pm 3$ | $94^{d} \pm 13$ | $108^{d} \pm 6$ | $87^{c} \pm 12$ |
| ONT-77 | $62^{dz} \pm 9$ | $61^{dz} \pm 4$ | $54^{dz} \pm 6$ | $59^{dz} \pm 10$ | $72^{dz} \pm 7$ | $73^{z} \pm 7$ | $95^{a} \pm 5$ | $87^{b} \pm 11$ |
| ONT-80 | $55^{cz} \pm 4$ | $59^{dz} \pm 3$ | $73^{dz} \pm 4$ | $67^{dz} \pm 10$ | $76^{dz} \pm 10$ | $76^{z} \pm 11$ | 87 ± 10 | $80^{bx} \pm 7$ |
| ONT-81 | $49^{bz} \pm 7$ | $62^{dz} \pm 19$ | $71^{dz} \pm 7$ | $74^{dz} \pm 7$ | $79^{dy} \pm 11$ | $88^{c} \pm 5$ | 90 ± 6 | $89^{c} \pm 8$ |

[a] Statistically different from the Mipomersen control group (ONT-41), with p < 0.05 (2-way ANOVA with Newman-Keuls post-hoc test)
[b] Statistically different from the Mipomersen control group (ONT-41), with p < 0.01 (2-way ANOVA with Newman-Keuls post-hoc test)
[c] Statistically different from the Mipomersen control group (ONT-41), with p < 0.001 (2-way ANOVA with Newman-Keuls post-hoc test)
[d] Statistically different from the Mipomersen control group (ONT-41), with p < 0.0001 (2-way ANOVA with Newman-Keuls post-hoc test)
[w] Statistically different from the PBS control group, with p < 0.05 (2-way ANOVA with Newman-Keuls post-hoc test)
[x] Statistically different from the PBS control group, with p < 0.01 (2-way ANOVA with Newman-Keuls post-hoc test)
[y] Statistically different from the PBS control group, with p < 0.001 (2-way ANOVA with Newman-Keuls post-hoc test)
[z] Statistically different from the PBS control group, with p < 0.0001 (2-way ANOVA with Newman-Keuls post-hoc test)

Compared with 10 mg/kg IP Mipomersen, ONT-75 administered with the same dosing paradigm resulted in significantly lower reduction (knockdown) of serum ApoB protein levels on days 17, 24, 31, 38, 45, 52, 60 (p<0.0001), and 66 (p<0.001) of the study. Compared with 10 mg/kg IP Mipomersen, ONT-77 administered with the same dosing paradigm resulted in significantly lower reduction (knockdown) of serum ApoB protein levels on days 17, 24, 31, 38, and 45 (p<0.0001), 60 (p<0.05) and 66 (p<0.01) of the study. Compared with 10 mg/kg IP Mipomersen, ONT-80 administered with the same dosing paradigm resulted in significantly lower reduction (knockdown) of serum ApoB protein levels on days 24, 31, 38 and 45 (p<0.0001),17 (p<0.001) and 66 (p<0.01). Compared with 10 mg/kg IP Mipomersen, ONT-81 administered with the same dosing paradigm resulted in significantly lower reduction (knockdown) of serum ApoB protein levels on days 24, 31, 38 and 45 (p<0.0001), 17 (p<0.01), 52 and 66 (p<0.001) of the study.

By day 38 (i.e. 6 days after the last dose), serum ApoB protein levels had returned to baseline after ONT-75. Considering the initial serum ApoB protein level reduction, the rate of return to baseline of serum ApoB protein was slower after ONT-77 and ONT-80 and the level of serum ApoB protein is similar to Mipomersen levels by day 52.

Figure 54:
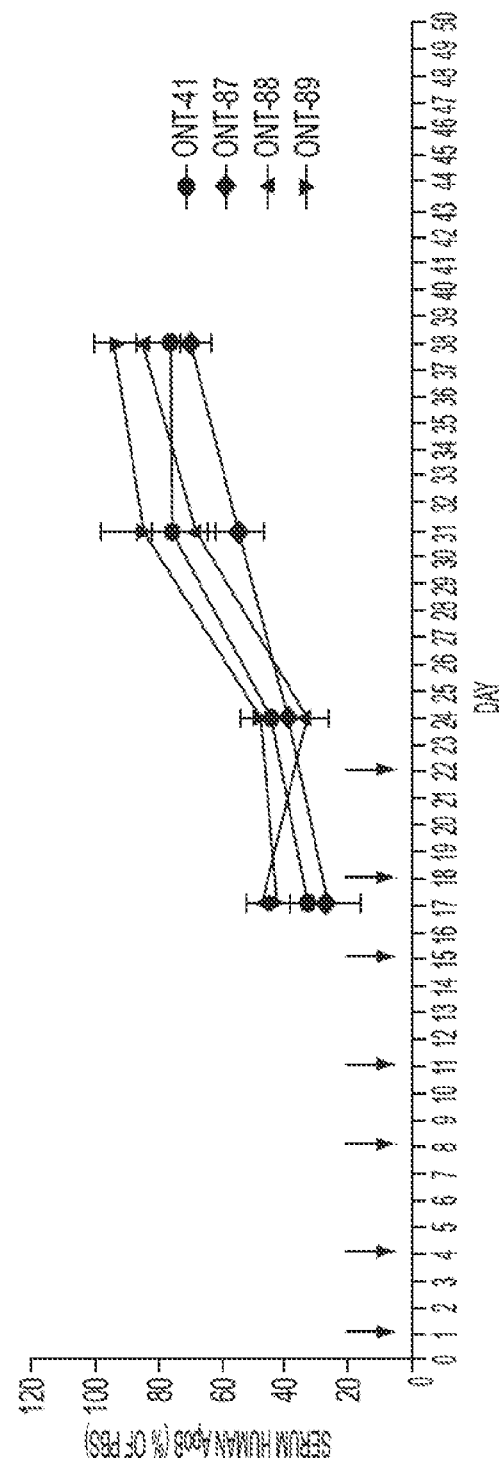
FIG. 54. Graphical representation of timecourse of serum human apolipoprotein B protein levels relative to PBS after multiple IP doses of 5 mg/kg stereoisomer or mipomersen in huApoB mice (n=3-4). A downward arrow indicates dosing days.

The results of the 5 mg/kg dosing paradigm of additional stereopure architectures are shown in Table E-28c and FIG. 54. Relative to PBS, 5 mg/kg IP ONT-87 resulted in significant reductions of serum ApoB protein levels on days 17, 24, 31 and 38 of the study, to 27% (p<0.0001), 40% (p<0.0001), 55% (p<0.0001) and 71% (p<0.0001) of control levels, respectively. Relative to PBS, 5 mg/kg IP ONT-88 resulted in significant reductions of serum ApoB protein levels on days 17, 24, 31 and 38 of the study, to 47% (p<0.0001), 34% (p<0.0001), 69% (p<0.0001) and 85% (p<0.0001) of control levels, respectively. Relative to PBS, 5 mg/kg IP ONT-89 resulted in significant reductions of serum ApoB protein levels on days 17, 24 and 31 of the study, to 43% (p<0.0001), 48% (p<0.0001) and 85% (p<0.05) of control levels, respectively.

TABLE E-28c

Serum Human Apolipoprotein B Levels Relative to PBS After
Multiple IP Doses of 5 mg/kg Stereoisomer (ONT-87, -88 or -89)
or Mipomersen in huApoB Mice (N = 3-4)

| SAMPLES | Day | | | |
|---|---|---|---|---|
| | 17 | 24 | 31 | 38 |
| PBS | 100 ± 5 | 100 ± 12 | 100 ± 4 | 100 ± 8 |
| ONT-41 | $33^{z} \pm 3$ | $44^{z} \pm 2$ | $75^{y} \pm 11$ | $76^{y} \pm 8$ |
| ONT-87 | $27^{z} \pm 11$ | $40^{z} \pm 5$ | $55^{bz} \pm 8$ | $71^{z} \pm 7$ |
| ONT-88 | $47^{az} \pm 5$ | $34^{z} \pm 8$ | $69^{z} \pm 13$ | $85^{z} \pm 7$ |
| ONT-89 | $43^{z} \pm 9$ | $48^{z} \pm 6$ | $85^{w} \pm 12$ | $93^{a} \pm 7$ |

[a] Statistically different from the Mipomersen control group (ONT-41), with p < 0.05 (2-way ANOVA with Newman-Keuls post-hoc test)
[b] Statistically different from the Mipomersen control group (ONT-41), with p < 0.01 (2-way ANOVA with Newman-Keuls post-hoc test)
[c] Statistically different from the Mipomersen control group (ONT-41), with p < 0.001 (2-way ANOVA with Newman-Keuls post-hoc test)
[d] Statistically different from the Mipomersen control group (ONT-41), with p < 0.0001 (2-way ANOVA with Newman-Keuls post-hoc test)
[w] Statistically different from the PBS control group, with p < 0.05 (2-way ANOVA with Newman-Keuls post-hoc test)
[x] Statistically different from the PBS control group, with p < 0.01 (2-way ANOVA with Newman-Keuls post-hoc test)
[y] Statistically different from the PBS control group, with p < 0.001(2-way ANOVA with Newman-Keuls post-hoc test)
[z] Statistically different from the PBS control group, with p < 0.0001 (2-way ANOVA with Newman-Keuls post-hoc test)

Compared with 5 mg/kg IP Mipomersen, ONT-87 administered with the same dosing paradigm resulted in significantly higher reduction (knock-down) of serum ApoB protein levels on day 31, (p<0.01) of the study. Compared with 5 mg/kg IP Mipomersen, ONT-88 administered with the same dosing paradigm resulted in significantly lower reduction (knock-down) of serum ApoB protein levels on day 17 (p<0.05 of the study). Compared with 5 mg/kg IP Mipomersen, ONT-89 administered with the same dosing paradigm resulted in significantly lower reduction (knockdown) of serum ApoB protein levels on day 38 (p<0.05) of the study.

Figure 55:
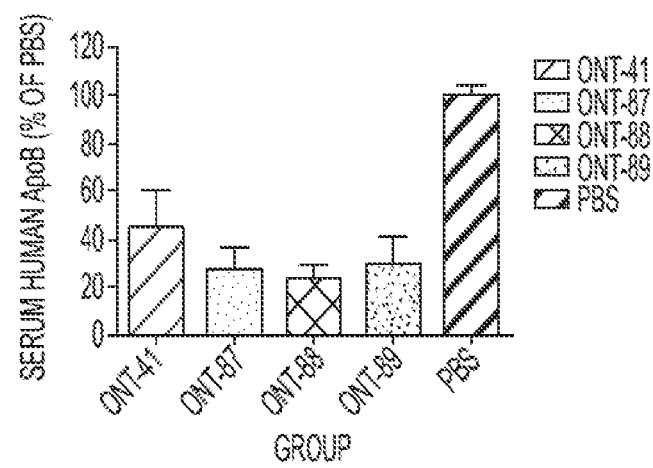
FIG. 55. Day 17 serum human apolipoprotein B protein levels relative to PBS after 10 mg/kg stereoisomer (ONT-87, ONT-88 or ONT-89) or mipomersen IP dosing in huApoB mice.
Figure 56:
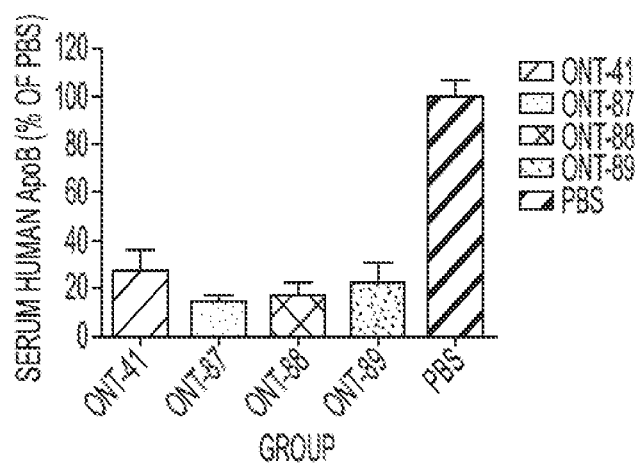
FIG. 56. Day 24 Serum Human Apolipoprotein B Protein Levels Relative to PBS After 10 mg/kg Stereoisomer (ONT-87, ONT-88 or ONT-89) or Mipomersen IP Dosing in huApoB Mice.
Figure 57:
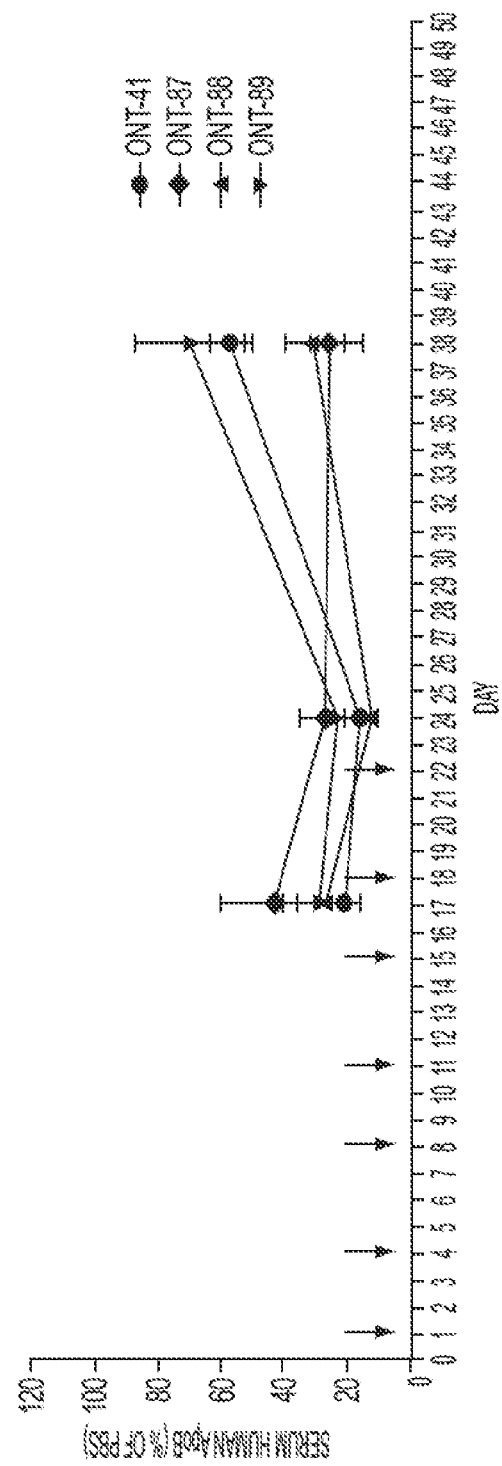
FIG. 57. Serum Human Apolipoprotein B Protein Levels Relative to PBS After 10 mg/kg Stereoisomer (ONT-41, ONT-87, ONT-88 or ONT-89) Dosing in huApoB Mice.
Figure 58:
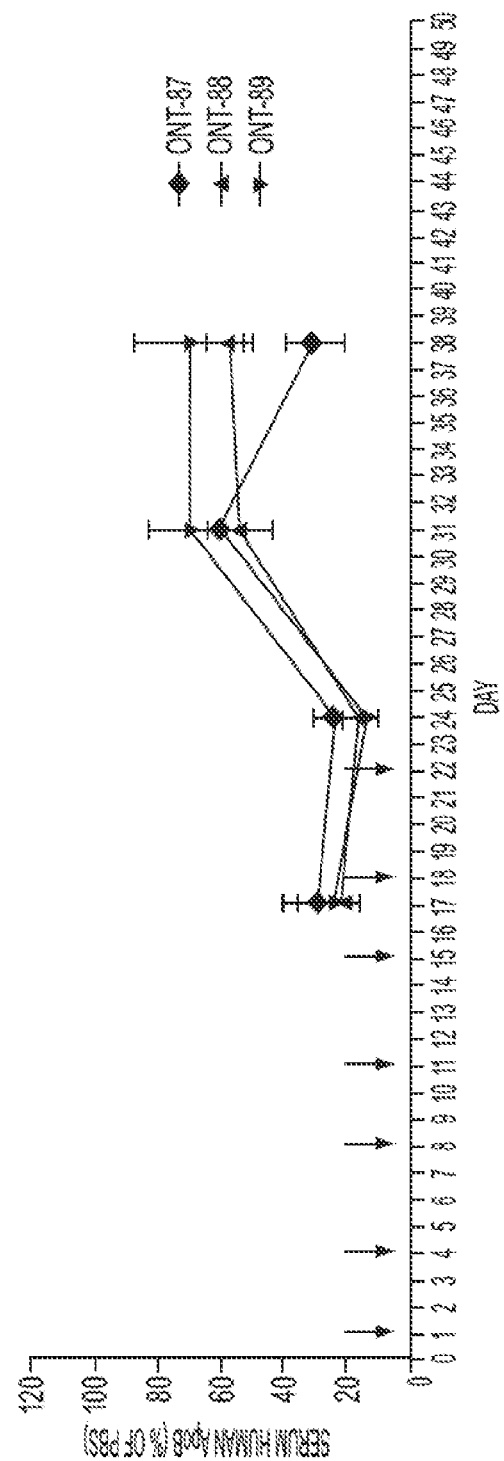
FIG. 58. Serum Human Apolipoprotein B Protein Levels Relative to PBS After 10 mg/kg Stereoisomer (ONT-87, ONT-88 or ONT-89) Dosing in huApoB Mice.

The results of the 10 mg/kg dosing paradigm of additional stereopure architectures are shown in Table E-28d and FIGS. 55 and 56. Relative to PBS, 10 mg/kg IP ONT-87 resulted in significant reductions of serum ApoB protein levels on days 17, and 24 of the study, to 27% (p<0.0001), 14% (p<0.0001) of control levels, respectively. Relative to PBS, 10 mg/kg IP ONT-88 resulted in significant reductions of serum ApoB protein levels on days 17, and 24 of the study, to 23% (p<0.0001), and 17% (p<0.0001) of control levels, respectively. Relative to PBS, 10 mg/kg IP ONT-89 resulted in significant reductions of serum ApoB protein levels on days 17, and 24 of the study, to 29% (p<0.0001), and 23% (p<0.0001) of control levels, respectively.

TABLE E-28d

Serum Human Apolipoprotein B Levels Relative to PBS After Multiple IP Doses of 10 mg/kg Stereoisomer (ONT-87, -88 or -89) or Mipomersen in huApoB Mice (N = 3-4)

| Sample | Day 17 | Day 24 |
|---|---|---|
| PBS | 100 ± 5 | 100 ± 8 |
| ONT-41 | $44^z$ ± 17 | $27^z$ ± 9 |
| ONT-87 | $27^{az}$ ± 10 | $14^z$ ± 3 |
| ONT-88 | $23^{az}$ ± 6 | $17^z$ ± 5 |
| ONT-89 | $29^{az}$ ± 12 | $23^z$ ± 8 |

$^a$Statistically different from the Mipomersen control group (ONT-41), with p < 0.05 (2-way ANOVA with Newman-Keuls post-hoc test)
$^b$Statistically different from the Mipomersen control group (ONT-41), with p < 0.01 (2-way ANOVA with Newman-Keuls post-hoc test)
$^c$Statistically different from the Mipomersen control group (ONT-41), with p < 0.001 (2-way ANOVA with Newman-Keuls post-hoc test)
$^d$Statistically different from the Mipomersen control group (ONT-41), with p < 0.0001 (2-way ANOVA with Newman-Keuls post-hoc test)
$^w$Statistically different from the PBS control group, with p < 0.05 (2-way ANOVA with Newman-Keuls post-hoc test)
$^x$Statistically different from the PBS control group, with p < 0.01 (2-way ANOVA with Newman-Keuls post-hoc test)
$^y$Statistically different from the PBS control group, with p < 0.001(2-way ANOVA with Newman-Keuls post-hoc test)
$^z$Statistically different from the PBS control group, with p < 0.0001 (2-way ANOVA with Newman-Keuls post-hoc test)

Compared with 10 mg/kg IP Mipomersen, ONT-87 administered with the same dosing paradigm resulted in significantly higher reduction (knockdown) of serum ApoB protein levels on day 17, (p<0.05) of the study. Compared with 10 mg/kg IP Mipomersen, ONT-88 administered with the same dosing paradigm resulted in significantly higher reduction (knockdown) of serum ApoB protein levels on day 17 (p<0.05) of the study. Compared with 10 mg/kg IP Mipomersen, ONT-89 administered with the same dosing paradigm resulted in significantly higher reduction (knockdown) of serum ApoB protein levels on day 17 (p<0.05) of the study.

Thus, in at least some embodiments, the present invention provides chirally controlled oligonucleotide compositions that show a biological activity and are characterized by extended persistence and/or slower rate of decay of that activity over time as compared with an appropriate reference (e.g., a preparation of oligonucleotides of the same sequence but different chiral specificity, including particularly stereorandom preparations). In some embodiments where such extended persistence and/or slower rate of decay is observed, provided chirally controlled compositions may be administered according to a dosing regimen with fewer total doses and/or longer periods between two or more doses that is utilized with the "parent" stereorandom composition to achieve comparable biologic and/or therapeutic effect. For example, the slower return to baseline of serum ApoB protein following treatment with chirally pure oligonucleotide compared with Mipomersen as demonstrated in the present Example, suggests that chirally pure ApoB oligonucleotides can be dosed less frequently than the parental stereorandom mixture (e.g., than Mipomersen).

The results presented in this Example demonstrate, for instance, that chirally pure oligonucleotide compositions can have significantly different pharmacological activity in vivo as compared with an appropriate reference (e.g., a preparation of oligonucleotides of the same sequence but different chiral specificity, including particularly stereorandom preparations), and specifically as compared with a "parental" stereorandom preparation. Those skilled in the art, in light of this demonstration, will appreciate that chirally controlled oligonucleotide compositions provided by the present disclosure have unexpected activities and characteristics. Those skilled in the art, in light of the present disclosure, will further appreciate that various methodologies are provided, including therapeutic methods that utilize dosing regimens that differ from those utilized for non-chirally controlled compositions (e.g., of the same nucleotide sequence). In some embodiments, relatively larger individual doses of chirally controlled (e.g., chirally pure) oligonucleotides may be utilized as compared with a control (e.g., a stereorandom control). In some embodiments, relatively smaller individual doses of chirally controlled (e.g., chirally pure) oligonucleotides may be utilized as compared with a control (e.g., a stereorandom control). In some embodiments, relatively fewer doses of chirally controlled (e.g., chirally pure) oligonucleotides may be utilized as compared with a control (e.g., a stereorandom control) within a given period of time.

Example 70: siRNA Agents Comprising Chirally Controlled Oligonucleotides Inhibit PCSK-9

The present Example demonstrates successful inhibition of target gene expression using siRNA agents comprised of chirally controlled oligonucleotides as described herein. Specifically, this Example describes hybridization of individual oligonucleotide strands prepared through chirally controlled synthesis as described herein, so that double-stranded chirally controlled siRNA oligonucleotide compositions are provided. This Example further demonstrates successful transfection of cells with such agents and, moreover, successful inhibition of target gene expression.

siRNA Transfection of Chiral siRNA Molecules

Hep3B, or HeLa cells were reverse transfected at a density of $2.0 \times 10^4$ cells/well in 96-well plates. Transfection of siRNA was carried out with lipofectamine RNAiMax (Life Technologies, cat. No. 13778-150) using the manufacturer's protocol, except with a decreased amount of Lipofectamine RNAiMax of 0.2 ul per well. Twelve, 1:3 siRNA duplex dilutions were created starting at 1 uM. 10 ul of 10× siRNA duplex was then lipoplexed with a prepared mixture of 9.8 ul of serum-free medium and 0.2 ul of Lipofectamine RNAiMax per well. After a 10-15 minute incubation, $2.0 \times 10^4$ cells in 80 ul of EMEM cell growing media (ATCC, 30-2003) were added to bring the final volume to 100 ul per well. Two separate transfection events were performed for each dose.

24 hours after transfection Hep3B or HeLa cells were lysed and PCSK9 mRNA was purified using MagMAX™-96 Total RNA Isolation Kit (Life Technologies, AM1830); 15 ul of cDNA was synthesized with High Capacity cDNA Reverse Transcription Kit with RNase Inhibitor (Life Technologies, 4374967). Gene expression was evaluated by Real-Time PCR on a Lightcycler 480 (Roche) using a Probes Master Mix (Roche, 04 707 494 001) according to manufacturer's protocol using a FAM-labeled Taqman probe-set for PCSK9 (Life Technologies, Hs03037355_m1) and a VIC-labeled GAPDH primer-limited endogenous control (Life Technologies, NM_002046.3).

IC50s and Data Analysis

Delta delta Ct method was used to calculate values. Samples were normalized to hGAPDH and calibrated to mock transfected and untreated samples. A stereo-random molecule was used as positive control. The data are represented as a mean of 2 biological replicates using Graphpad Prism. A four-parameter linear regression curve was fitted to the data and the bottom and top were constrained to a 0 and 100 constants respectively in order to calculate a relative IC50.

TABLE E-29

Relative IC50 values [Hep3B Transfection]

| | | LogIC50 | | HillSlope | | |
|---|---|---|---|---|---|---|
| | Bottom | Top | Mean | SEM | Mean | SEM | IC50 [nM] |
| ONT-D1 | 0 | 100 | −0.39 | 0.12 | −0.27 | 0.02 | 0.41 |
| ONT-D2 | 0 | 100 | −0.85 | 0.14 | −0.24 | 0.03 | 0.14 |
| ONT-D3 | 0 | 100 | −0.62 | 0.14 | −0.24 | 0.02 | 0.24 |
| ONT-D4 | 0 | 100 | −0.49 | 0.09 | −0.28 | 0.02 | 0.33 |
| ONT-D5 | 0 | 100 | −0.32 | 0.09 | −0.31 | 0.02 | 0.48 |

TABLE E-30

Relative IC50 values [HeLa Transfection]

| | | LogIC50 | | HillSlope | | |
|---|---|---|---|---|---|---|
| | Bottom | Top | Mean | SEM | Mean | SEM | IC50 |
| ONT-D1 | 0 | 100 | −1.73 | 0.07 | −0.61 | 0.05 | 0.02 |
| ONT-D2 | 0 | 100 | −1.94 | 0.07 | −0.66 | 0.07 | 0.01 |
| ONT-D3 | 0 | 100 | −1.72 | 0.08 | −0.62 | 0.07 | 0.02 |
| ONT-D4 | 0 | 100 | −1.26 | 0.06 | −0.74 | 0.06 | 0.06 |
| ONT-D5 | 0 | 100 | −1.03 | 0.08 | −0.86 | 0.12 | 0.09 |

TABLE E-31

Relative IC50 values of siRNAs with 3 Phosporothioate stereo-centers [HeLa Transfection]

| | | LogIC50 | | HillSlope | | |
|---|---|---|---|---|---|---|
| | Bottom | Top | Mean | SEM | Mean | SEM | IC50 |
| ONT-D7 | 0 | 100 | 0.75 | 0.15 | −0.24 | 0.02 | 5.60 |
| ONT-D8 | 0 | 100 | 0.39 | 0.09 | −0.32 | 0.02 | 2.45 |
| ONT-D9 | 0 | 100 | 0.43 | 0.13 | −0.22 | 0.02 | 2.68 |
| ONT-D10 | 0 | 100 | 1.57 | 0.20 | −0.27 | 0.03 | 36.86 |
| ONT-D11 | 0 | 100 | 2.92 | 0.33 | −0.12 | 0.01 | 839.42 |
| ONT-D12 | 0 | 100 | −0.17 | 0.10 | −0.38 | 0.03 | 0.68 |
| ONT-D13 | 0 | 100 | 1.20 | 0.21 | −0.39 | 0.08 | 15.97 |
| ONT-D14 | 0 | 100 | −0.22 | 0.18 | −0.43 | 0.07 | 0.60 |
| ONT-D15 | 0 | 100 | −0.25 | 0.16 | −0.41 | 0.06 | 0.57 |

Figure 45:
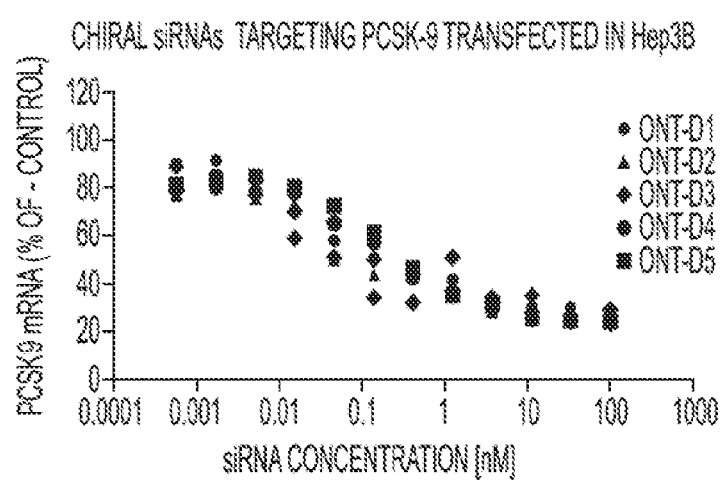
FIG. 45. Graphical representation of % PCSK-9 mRNA remaining after Hep3B treatment with siRNA duplex.
Figure 46:
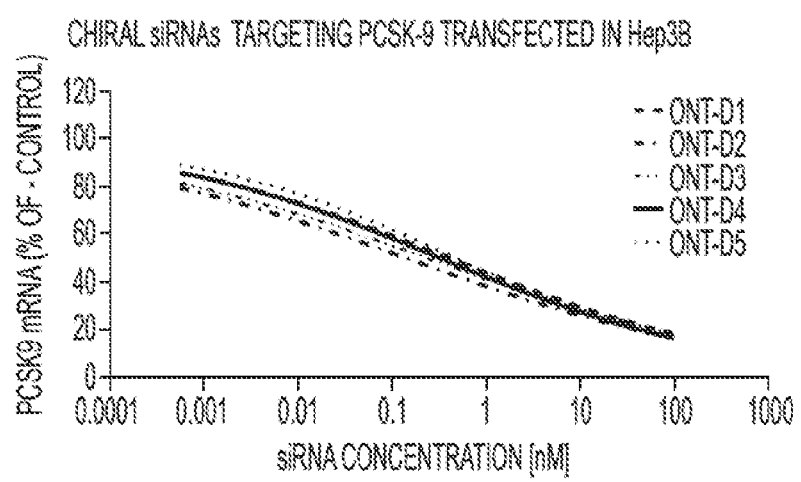
FIG. 46. Graphical representation of % PCSK-9 mRNA remaining after Hep3B treatment with siRNA duplex curve fit.
Figure 47:
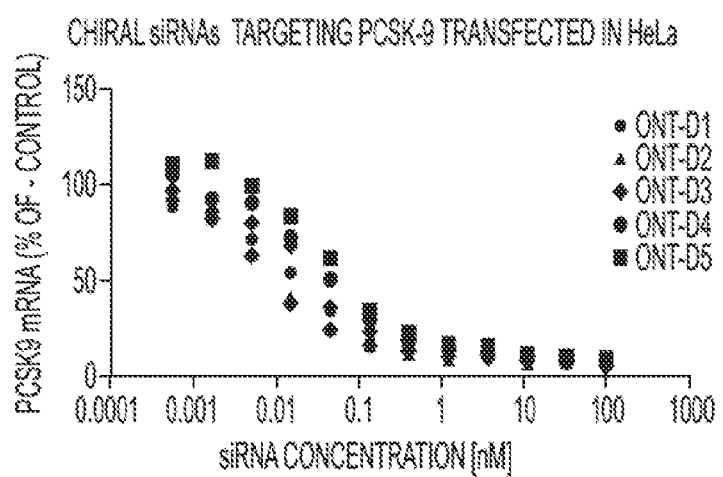
FIG. 47. Graphical representation of % PCSK-9 mRNA remaining after HeLa treatment with siRNA duplex.
Figure 48:
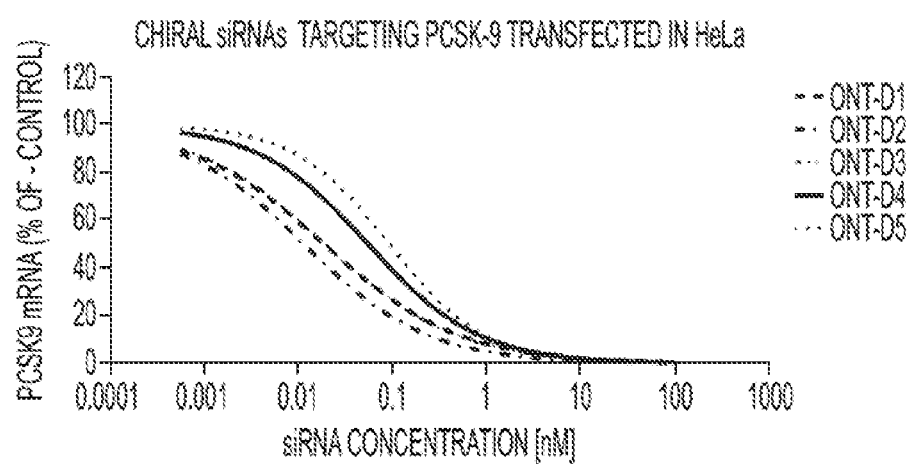
FIG. 48. Graphical representation of % PCSK-9 mRNA remaining after HeLa treatment with siRNA duplex curve fit.
Figure 49:
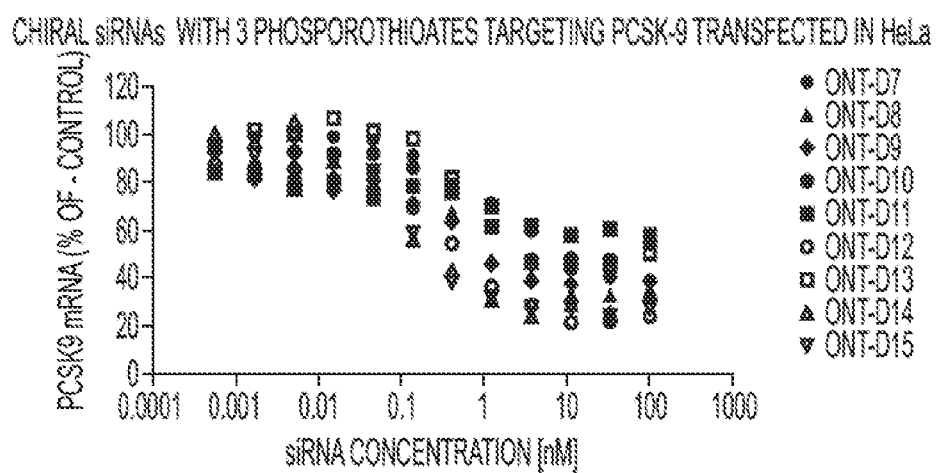
FIG. 49. Graphical representation of % PCSK-9 mRNA remaining after HeLa treatment with siRNA duplex containing 3 Phophorothiate stereo-centers.
Figure 50:
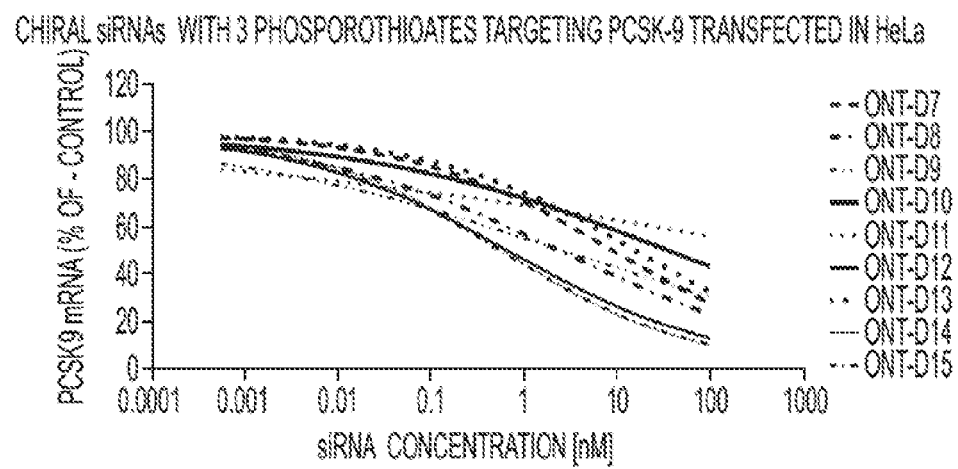
FIG. 50. Graphical representation of % PCSK-9 mRNA remaining after HeLa treatment with siRNA duplex containing 3 Phophorothiate stereo-centers curve fit.

FIGS. 45-50 present results of these studies. FIG. 45 shows the % PCSK-9 mRNA remaining after Hep3B treatment with siRNA duplex. FIG. 46 shows the % PCSK-9 mRNA remaining after Hep3B treatment with siRNA duplex curve fit. FIG. 47 shows the % PCSK-9 mRNA remaining after HeLa treatment with siRNA duplex. FIG. 48 shows the % PCSK-9 mRNA remaining after HeLa treatment with siRNA duplex curve fit. FIG. 49 shows the % PCSK-9 mRNA remaining after HeLa treatment with siRNA duplex containing 3 Phophorothiate stereo-centers. FIG. 50 shows the % PCSK-9 mRNA remaining after HeLa treatment with siRNA duplex containing 3 Phophorothiate stereo-centers curve fit.

As can be seen, in molecules with a single sterochemically defined phosphorothioate in each strand, a slightly increased potency was observed with molecules with Sp stereo-chemistry at the phosphorothioate in both sense and antisense strands While the specifically exemplified siRNA agents contained only one chiral center per strand, those skilled in the art, reading the present disclosure, will recognize the significance of the demonstrated differential effect as proof of principle that presence of chirality can impact activity.

The impact of chirality is more pronounced in siRNAs with more than two stereo-centers. In siRNAs with 3 chiral phosphorothioates (one in the sense strand and two in the antisense strand), an Sp stereochemistry at the 5' end (between nucleotides n1 and n2) combined with a Rp stereochemistry at the 3' end (between nucleotides n20 and n21) of the antisense strand had deleterious effect on potency. However, an Rp stereochemistry at the 5' end (between nucleotides n1 and n2) combined with a Sp stereochemistry at the 3' end (between nucleotides n20 and n21) of the antisense strand showed a significant PCSK-9 mRNA knockdown improvement over stereo-random control siRNA. The results suggest that both strands are affected by the stereochemistry of the phosphorothioate. It is likely that the observed efficacy differential will increase for agents with larger numbers of chiral centers and, moreover that both location and type of chiral center can impact activity, for example through effects on stability, potency, and/or both. Those skilled in the art, reading the present disclosure, will therefore appreciate that it provides teachings of both single and double-stranded chirally controlled oligonucleotide compositions, and uses thereof that, in at least some embodiments, distinguish such chirally controlled oligonucleotides and agents from stereorandom agents of identical sequence.

Example 71. Additional Exemplary Oligonucleotides and Synthesis Thereof

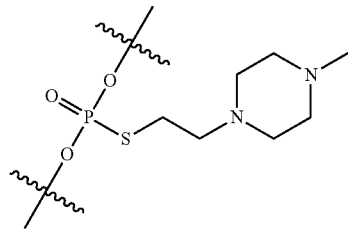

s16

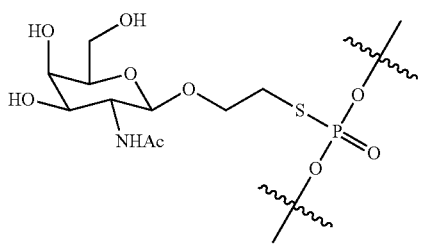

s17

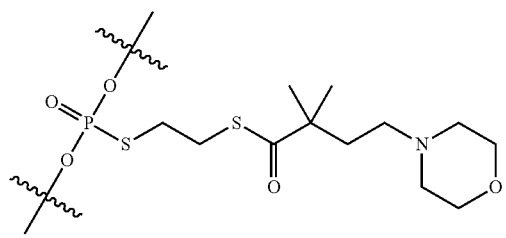

s18

Oligonucleotides N101-N104 were synthesized using the automated synthesis on ABI-394 DNA/RNA synthesizer according to the synthetic cycle summarized on Table E-32, using 1 µmol synthesis column and 1.7 µmol of oxalyl linked dG$^{CE,Pac}$ on HCP. The synthesis cycle was performed with removal of the terminal 5'-O-DMTr group (DMT Off). After completion of the automated oligonucleotide synthesis, the HCP support was washed with dry ACN and dried under vacuum. The dry HCP was placed in a plastic vial and was treated with 1 mL of sat. NH$_3$/Py for 1 h at 55° C. then 1 mL of dry propylamine in dry pyridine (in a 1:4 ratio) for 18 h at RT. The solvents were then evaporated and the residue was re-suspended with ~pH 1.5 HCl aqueous solution containing 10% DMSO and the HCP support was filtered off. The crude product was purified by reverse phase preparative HPLC (According to the procedure described below). The fractions having purity above 95% were pooled, concentrated and desalted by reverse-phase HPLC (According to the procedure described below). The final desalted product was lyophilized from water.

TABLE E-32

Summary for Oligonucleotide Synthesis on a DNA/RNA Synthesizer ABI-394 Used for the Synthesis of oligonucleotides N101-N102.

| step | reaction | reagent | delivery time (sec) | wait time (sec) |
|---|---|---|---|---|
| 1 | detritylation | 3% TCA in DCM | 3 + 60 + 10 | N.A. |
| 2 | coupling | 0.15M phosphoramidite in ACN + 1.2M CMPT in ACN | 5 + 4 | 30 + 600 |
| 3 | capping 1 | 5% Pac$_2$O in THF/2,6-lutidine | 20 | 60 |
| 4 | capping 2 | 5% Pac$_2$O in THF/2,6-lutidine + 16% NMI in THF | 20 | 60 |
| 5 | sulfurization | 0.3M S-(N-methylpiperazinoethyl-ToluylThioSulfonate in ACN/BSTFA | 7 + 1.5 × 4 | 360 + 3 × 180 + 900 |

Example 72. HPLC Method for N101 and N102

Buffer A: 50 mM TEAA, pH 9.6 (adjusted with TEA)
Buffer B: ACN
Column: XBridge C$_8$, 3.5 µm, 4.6×50 mm, Part #186003034
Buffer heater set temperature=35° C.
Signal monitored at 254 and 280 nm
Gradient Used:

| Time | Flow (ml/min) | % A | % B | Curve |
|---|---|---|---|---|
| Initial | | 99 | 1 | |
| 2 | 1 | 99 | 1 | 1 |
| 22 | 1 | 70 | 30 | 6 |
| 25 | 1 | 5 | 95 | 6 |
| 25.5 | 1 | 5 | 95 | 6 |
| 30 | 1 | 99 | 1 | 1 |

Example 73. General UPLC-LCMS Method for N101 and N102

Buffer A: 10 mM ammonium formate, pH 9.5 (adjusted with NH$_3$ aq.)
Buffer B: ACN
Column: UPLC@OST C$_{18}$ 1.7 µm, 2.1×500 mm
Column temperature=35° C.
Gradient Used:

| Time (min) | Flow (mL/min) | % A | % B | Curve |
|---|---|---|---|---|
| Initial | 0.5 | 99 | 1 | |
| 2 | 0.5 | 99 | 1 | 1 |
| 12 | 0.5 | 60 | 40 | 6 |
| 13 | 0.5 | 5 | 95 | 6 |
| 13.5 | 0.5 | 5 | 95 | 6 |
| 15 | 0.5 | 99 | 1 | 1 |

Example 74. General Purification Method for N101 and N102

Buffer A: 50 mM TEAA pH=9.6 (adjusted with TEA)
Buffer B: ACN
Column: XBridge Prep C$_{18}$, 5 µm, C$_{18}$, 250×10 mm, Part #186003256
Buffer heater set temperature=RT
Signal monitored at 254 and 280 nm
Gradient Used:

| Time | Flow (ml/min) | % A | % B | Curve |
|---|---|---|---|---|
| Initial | | 99 | 1 | |
| 5 | 4 | 99 | 1 | 1 |
| 10 | 4 | 95 | 5 | 6 |
| 30 | 4 | 74 | 26 | 6 |
| 35 | 4 | 5 | 95 | 6 |
| 36 | 4 | 5 | 95 | 6 |
| 38 | 4 | 99 | 1 | 6 |
| 45 | 4 | 99 | 1 | 1 |

100 µL of 49-51% phosphoric acid was added to each fraction (pH 3) and checked by HPLC, then stored at −80° C. until frozen. The fractions were kept on lypholizer for a couple of hours until ½ volumes then stored at −80° C.

Example 75. General Desalting Method for N101 and N102

Buffer A: 10 mM formic acid
Buffer B: ACN
Column: XBridge Prep $C_{18}$, 5 μm, $C_{18}$, 250×10 mm, Part #186003256
Buffer heater set temperature=RT
Signal monitored at 254 and 280 nm
Gradient Used:

| Time | Flow (ml/min) | % A | % B | Curve |
|---|---|---|---|---|
| Initial |   | 100 | 0 |   |
| 12 | 4 | 100 | 0 | 1 |
| 13 | 4 | 65 | 35 | 6 |
| 21 | 4 | 65 | 35 | 1 |
| 21.5 | 4 | 100 | 0 | 6 |
| 30 | 4 | 100 | 0 | 1 |

Collected fractions were stored in −80° C. until frozen and kept on lypholizer until dryness and checked by HPLC.

Example 76. Synthesis of Oligonucleotide N101 (All-(Rp)-d[5mCs16As16Gs16T]

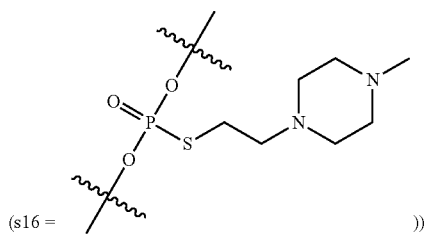

(s16 = ))

Oligonucleotide N101 was synthesized as described above and purified. RT in RP-HPLC: (HPLC method N1): 15.9 min. UPLC/ESI-MS: Calcd: 1614.64; Found [+H]: 1615.06.

Example 77. Synthesis of Oligonucleotide N102 (All-(Sp)-d[5mCs16As16Gs16T])

Oligonucleotide N102 was synthesized as described above and purified. RT in RP-HPLC (HPLC method N1): 16.4 min. UPLC/ESI-MS: Calcd: 1614.64; Found [+H]: 1614.97.

Example 78. Synthesis of Oligonucleotide N103 (All-(Rp)-d [5mCs16As16Gs16Ts165mCs16Ts16Gs165mCs16Ts16Ts165mCs16G] (SEQ ID NO: 125))

Oligonucleotide N103 was synthesized as described above. RT in RP-HPLC (HPLC method N1): 18.4 min. UPLC/ESI-MS: Calcd for $C_{197}H_{311}N_{62}O_{62}P_{11}S_{11}$: 5233.38; Found: 5234.7.

Example 79. Synthesis of Oligonucleotide N104 (All-(Sp)-d [5mCs16As16Gs16Ts165mCs16Ts16Gs165mCs16Ts16Ts165mCs16G] (SEQ ID NO: 125))

Oligonucleotide N104 was synthesized as described above. RT in RP-HPLC (HPLC method N1): 18.7 min. UPLC/ESI-MS: Calcd: 5233.38; Found: 5232.9.

Oligonucleotides N105-N106 were synthesized using the automated synthesis on ABI-394 DNA/RNA synthesizer according to the synthetic cycle summarized on Table E-33, using 1 μmol synthesis column and 1.7 μmol of oxalyl linked $dG^{CE,Pac}$ on HCP. The synthesis cycle was performed with removal of the terminal 5'-O-DMTr group (DMT Off). After completion of the automated oligonucleotide synthesis, the HCP support was washed with dry ACN and dried under vacuum. The dry HCP was placed in a plastic vial and was treated with 1 mL of sat. $NH_3$/i-PrOH for 16 h at 55° C. The solvent was then evaporated and the residue was re-suspended with pH 7.0 aqueous solution containing 10% DMSO and the HCP support was filtered off. The crude product is purified by reverse phase preparative HPLC. The fractions having purity above 95% are pooled, concentrated and desalted by reverse-phase HPLC. The final desalted product is lyophilized from water.

TABLE E-33

Summary for Oligonucleotide Synthesis on a DNA/RNA Synthesizer ABI-394 Used for the Synthesis of oligonucleotides N105-N106.

| step | reaction | reagent | delivery time (sec) | wait time (sec) |
|---|---|---|---|---|
| 1 | detritylation | 3% TCA in DCM | 3 + 60 + 10 | N.A. |
| 2 | coupling | 0.15M phosphoramidite in ACN + 1.2M CMPT in ACN | 5 + 4 | 30 + 600 |
| 3 | capping 1 | 5% $Pac_2O$ in THF/2,6-lutidine | 20 | 60 |
| 4 | capping 2 | 5% $Pac_2O$ in THF/2,6-lutidine + 16% NMI in THF | 20 | 60 |
| 5 | sulfurization | 0.3M | 7 + 1.5 × 4 | 360 + 3 × 180 + 900 |

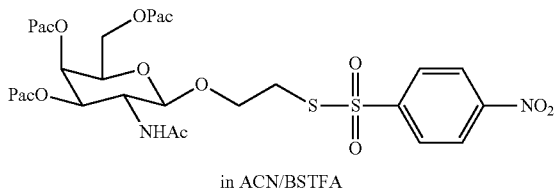

in ACN/BSTFA

Example 80. HPLC Method for N101 and N102

Buffer A: 50 mM TEAA, pH 7.0
Buffer B: ACN
Column: XBridge C$_8$, 3.5 μm, 4.6×150 mm, Part #186003034
Buffer heater set temperature=35° C.
Signal monitored at 254 and 280 nm
Gradient Used:

| Time | Flow (ml/min) | % A | % B | Curve |
|---|---|---|---|---|
| Initial |  | 99 | 1 |  |
| 2 | 1 | 99 | 1 | 1 |
| 22 | 1 | 80 | 20 | 6 |
| 25 | 1 | 5 | 95 | 6 |
| 25.5 | 1 | 5 | 95 | 6 |
| 30 | 1 | 99 | 1 | 1 |

Example 81. General UPLC-LCMS Method for N101 and N102

Buffer A: 10 mM ammonium formate, pH 7.0
Buffer B: ACN
Column: UPLC@OST C$_{18}$ 1.7 μm, 2.1×500 mm
Column temperature=35° C.
Gradient Used:

| Time (min) | Flow (mL/min) | % A | % B | Curve |
|---|---|---|---|---|
| Initial | 0.5 | 99 | 1 |  |
| 2 | 0.5 | 99 | 1 | 1 |
| 12 | 0.5 | 70 | 30 | 6 |
| 13 | 0.5 | 5 | 95 | 6 |
| 13.5 | 0.5 | 5 | 95 | 6 |
| 15 | 0.5 | 99 | 1 | 1 |

Example 82. Synthesis of Oligonucleotide N105 (All-(Rp)-d[5mCs9As9Gs9T]

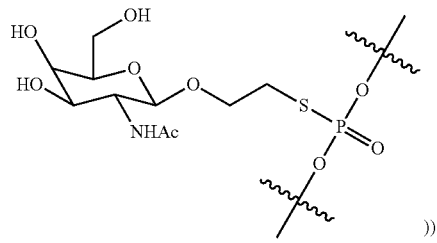

(s9 = )

Oligonucleotide N105 was synthesized as described above. RT in RP-HPLC: (HPLC method N2): 14.1 min. UPLC/ESI-MS: Calcd: 1977.78; Found [−H]: 1978.8.

Example 83. Synthesis of Oligonucleotide N106 (All-(Sp)-d[5mCs9As9Gs9T])

Oligonucleotide N106 was synthesized and purified as described above. RT in RP-HPLC (HPLC method N2): 14.7 min. UPLC/ESI-MS: Calcd: 1977.78; Found [−H]: 1977.37.

Oligonucleotides xxx were synthesized using the automated synthesis on ABI-394 DNA/RNA synthesizer according to the synthetic cycle summarized on Table E-33, using 1 μmol synthesis column and 1.7 μmol of oxalyl linked dG$^{CE,Pac}$ on HCP. The synthesis cycle was performed with removal of the terminal 5′-O-DMTr group (DMT Off). After completion of the automated oligonucleotide synthesis, the HCP support was washed with dry ACN and dried under vacuum. The dry HCP was placed in a plastic vial and was treated with 1 mL of sat. NH$_3$/i-PrOH for 16 h at 55° C. The solvent was then evaporated and the residue was re-suspended with pH 7.0 aqueous solution containing 10% DMSO and the HCP support was filtered off. The crude product is purified by reverse phase preparative HPLC. The fractions having purity above 95% are pooled, concentrated and desalted by reverse-phase HPLC. The final desalted product is lyophilized from water.

TABLE E-34

Summary for Oligonucleotide Synthesis on a DNA/RNA Synthesizer ABI-394.

| step | reaction | reagent | delivery time (sec) | wait time (sec) |
|---|---|---|---|---|
| 1 | detritylation | 3% TCA in DCM | 3 + 60 + 10 | N.A. |
| 2 | coupling | 0.15M phosphoramidite in ACN + 1.2M CMPT in ACN | 5 + 4 | 30 + 600 |
| 3 | capping 1 | 5% Pac$_2$O in THF/2,6-lutidine | 20 | 60 |
| 4 | capping 2 | 5% Pac$_2$O in THF/2,6-lutidine + 16% NMI in THF | 20 | 60 |
| 5 | sulfurization | 0.3M | 10 + 4 × 2 | 300 + 3 × 150 + 600 |

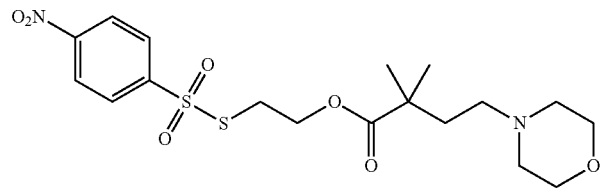

in ACN/BSTFA

Example 84. General Purification Method

Buffer A: 50 mM TEAA
Buffer B: ACN
Column: XBridge Prep $C_{18}$, 5 μm, $C_{18}$, 250×10 mm, Part #186003256
Buffer heater set temperature=rt
Signal monitored at 254 and 280 nm
Gradient Used:

| Time | Flow (ml/min) | % A | % B | Curve |
|---|---|---|---|---|
| Initial | | 99 | 1 | |
| 5 | 4 | 99 | 1 | 1 |
| 10 | 4 | 95 | 5 | 6 |
| 30 | 4 | 74 | 26 | 6 |
| 35 | 4 | 5 | 95 | 6 |
| 36 | 4 | 5 | 95 | 6 |
| 38 | 4 | 99 | 1 | 6 |
| 45 | 4 | 99 | 1 | 1 |

HPLC Method 5:

| Time | Flow (ml/min) | % A | % B | Curve |
|---|---|---|---|---|
| Initial | | 80 | 20 | |
| 2 | 1 | 80 | 20 | 1 |
| 22 | 1 | 45 | 55 | 6 |
| 25 | 1 | 5 | 95 | 6 |
| 25.5 | 1 | 5 | 95 | 6 |
| 26 | 1 | 85 | 20 | 6 |
| 30 | 1 | 85 | 20 | 1 |

ONT-60: Oligonucleotide 149 All-(Rp)-d[5mCs8As8Gs8Ts85mCs8Ts8Gs85mCs8Ts8Ts85mCs8G] (SEQ ID NO: 125)

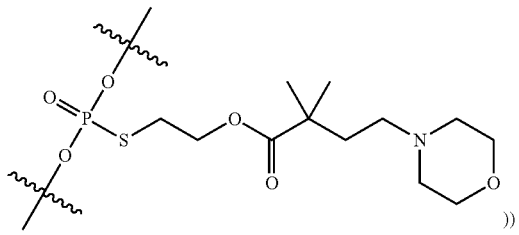

(s8 =                            ))

The oligonucleotide was synthesized as described above. RT in RP-HPLC (HPLC method 5): 15.80 min. UPLC/ESI-MS: Calcd: 6345.6; Found: 6340.7.

ONT-69: All-(Sp)-d[5mCs16As8Gs8Ts85mCs8Ts8Gs85m Cs8Ts 8Ts85 mCs8G] (SEQ ID NO: 125)

The oligonucleotide was synthesized as described above. RT in RP-HPLC (HPLC method 5): 18.61 min. UPLC/ESI-MS: Calcd: 6345.6; Found: 6340.6.

Example 85

The P-modified blockmer and altmer oligonucleotides containing both stereodefined phosphorothioate diester and stereodefined morpholinoethyl phosphorothioate triester internucleotidic linkages were synthesized on an ABI-394 DNA/RNA synthesizer according to the cycle summarized in Table E-4 using 1 μmol synthesis column and 1.7 μmol of oxalyl linked $dG^{CE,Pac}$ On HCP. Either stereodefined P-modified phosphorothioate linkage was introduced at predetermined positions within the sequence by performing either sulfurization step (1) or (2). The synthesis cycle was performed with removal of the terminal 5'-O-DMTr group (DMT Off). The solid support was washed with dry ACN and dried under a flux of argon. The dry HCP was placed in a plastic vial and was treated with 1 mL of dry propylamine in dry pyridine (in a 1:4 ratio) for a period of 18 h at r.t. The solvents were then evaporated and the residue was re-suspended in DMSO and the HCP support was filtered off. The crude product was purified by reverse phase preparative HPLC. The fractions having purity above 95% were pooled, concentrated and desalted by reverse-phase HPLC (Gradient of 0 to 80% ACN). The final desalted product was lyophilized from water.

TABLE E-4

Summary for Oligonucleotide Synthesis on a DNA/RNA Synthesizer ABI-394 Used for the Synthesis of Example 85.

| step | reaction | reagent | delivery time (sec) | wait time (sec) |
|---|---|---|---|---|
| 1 | detritylation | 3% TCA in DCM | 3 + 60 + 10 | N.A. |
| 2 | coupling | 0.15M phosphoramidite in ACN + 1.2M CMPT in ACN | 5 + 4 | 30 + 600 |
| 3 | capping 1 | 5% $Pac_2O$ in THF/2,6-lutidine | 20 | 60 |
| 4 | capping 2 | 5% $Pac_2O$ in THF/2,6-lutidine + 16% NMI in THF | 20 | 60 |

TABLE E-4-continued

Summary for Oligonucleotide Synthesis on a DNA/RNA Synthesizer ABI-394 Used for the Synthesis of Example 85.

| step | reaction | reagent | delivery time (sec) | wait time (sec) |
|---|---|---|---|---|
| 5 | sulfurization 1 | 0.3M S-Morpholinoethyl p-Chlorophenyl thiosulfonate 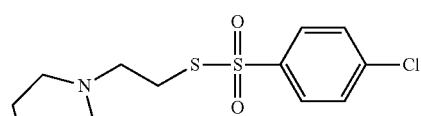 in ACN/BSTFA | 10 + 4 × 2 | 300 + 3 × 150 + 600 |
| 6 | sulfurization 2 | 0.3M S-cyanoethyl Methylthiosulfonate 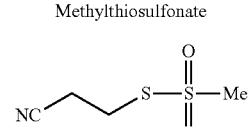 in ACN/BSTFA | 10 + 4 × 2 | 300 + 3 × 150 + 60 |

Example 86. General Purification Method for Example 85

Buffer A: 20 mM Phosphate pH=6.0 (adjusted with phosphoric acid)
Buffer B: ACN
Column: XBridge Prep $C_{18}$, 5 μm, $C_{18}$, 250×10 mm, Part #186003256
Buffer heater set temperature=50° C.
Signal monitored at 254 and 280 nm
Gradient Used:

| Time | Flow (ml/min) | % A | % B | Curve |
|---|---|---|---|---|
| Initial |  | 99 | 1 |  |
| 5 | 4 | 99 | 1 | 1 |
| 10 | 4 | 77 | 23 | 6 |
| 60 | 4 | 70 | 30 | 6 |
| 65 | 4 | 20 | 80 | 6 |
| 70 | 4 | 20 | 80 | 6 |
| 71 | 4 | 99 | 1 | 6 |
| 80 | 4 | 99 | 1 | 1 |

HPLC Method 6
Buffer A: 20 mM Ammonium acetate, pH 6.0
Buffer B: ACN
Column: XBridge $C_8$, 3.5 μm, 4.6×150 mm, Part #186003034
Buffer heater set temperature=60° C.
Signal monitored at 254 and 280 nm
Gradient Used:

| Time | Flow (ml/min) | % A | % B | Curve |
|---|---|---|---|---|
| Initial |  | 90 | 10 |  |
| 2 | 1 | 90 | 10 | 1 |
| 22 | 1 | 75 | 25 | 6 |
| 25 | 1 | 5 | 95 | 6 |
| 25 | 1 | 5 | 95 | 6 |
| 25.5 | 1 | 90 | 10 | 6 |
| 30 | 1 | 90 | 10 | 1 |

ONT-71: All-(Rp)-d[5mCs1As1GsTs5mCsTsGs5mCsTsTs15mCs1G] (SEQ ID NO: 125)

The oligonucleotide was synthesized as described above. RT in RP-HPLC (HPLC method 6): 9.39 min. UPLC/ESI-MS: Calcd: 4297.9; Found: 4295.3.

ONT-72: All-(Sp)-d[5mCs1As1GsTs5mCsTsGs5mCsTsTs15mCs1G] (SEQ ID NO: 125)

The oligonucleotide was synthesized as described above. RT in RP-HPLC (HPLC method 6): 10.84 min. UPLC/ESI-MS: Calcd: 4297.9; Found: 4295.7.

ONT-73: All-(Rp)-d[5mCs1AsGs1Ts5mCs1TsGs15mCsTs1Ts5mCs1G] (SEQ ID NO: 125)

The oligonucleotide was synthesized as described above. RT in RP-HPLC (HPLC method 6): 13.54 min. UPLC/ESI-MS: Calcd: 4524.2; Found: 4522.6.

ONT-74: All-(Sp)-d[5mCs1AsGs1Ts5mCs1TsGs15mCsTs1Ts5mCs1G] (SEQ ID NO: 125)

The oligonucleotide was synthesized as described above. RT in RP-HPLC (HPLC method 6): 15.52 min. UPLC/ESI-MS: Calcd: 4524.2; Found: 4521.0.

Prodrug oligonucleotide properties such as: nuclease resistance, tissue accumulation, cell penetration, endosomal escape, immunostimulation, duration of action, pharmacokinetics, etc. are all modulated and influenced by the stereochemistry of the chiral phosphorothioate backbone linkages.

RNA oligonucleotides containing 2'-OH, 2'-OMe, 2'-F, 2'-deoxy, internucleotidic phosphodiester or internucleotidic stereodefined phosphorothioate diester or internucleotidic stereodefined phosphorothioate triester (ProDrug) (either releasing a internucleotidic phosphodiester (PO) or a internucleotidic stereodefined phosphorothioate diester (PS)) linkages are synthesized on ABI 394 DNA/RNA synthesizer according to the cycles summarized in Table E-35, Table E-36, Table E-37 and Table E-38, using a 10 μmol capacity synthesis column loaded with 130 mg (4.9 μmol) of oxalyl linked 5'-O-DMTr-2'-deoxythymidine prepared as previously described. Prior to synthesis, a preliminary capping step (capping 2) is performed and the synthesis is terminated with removal of the terminal 5'-O-DMTr groups. The oxidation step is performed using a commercially available 5-6 M solution of tert-butyl hydroperoxide (TBHP) in decane which was then diluted with four parts dichloromethane. The stereospecific sulfurization step for internucleotidic stereodefined phosphorothioate diester linkage is performed using the 0.3 M S-cyanoethylmethylthiosulfonate reagent following the coupling of the corresponding chiral phosphoramide and the two-step capping process (Table E-36). The stereospecific sulfurization step for internucleotidic stereodefined phosphorothioate triester releasing a stereodefined internucleotidic phosphodiester (PS) linkage is performed using the 0.3 M S—(N-morpholinoethylthioester-ethyl)-para-nitro-toluylthiosulfonate reagent following the coupling of the corresponding chiral phosphoramide and the two-step capping process (Table E-37). The stereospecific sulfurization step for internucleotidic stereodefined phosphorothioate triester releasing an internucleotidic phosphodiester (PO) linkage is performed using the 0.3 M S—(N-morpholinoethyl)-toluylthiosulfonate reagent following the coupling of the corresponding chiral phosphoramide and the two-step capping process (Table E-38). For 2'-OH RNA nucleotides, 2'-O-base protecting groups are used, such as 2'-O-PivOM (Debart et al., *Chem. Eur. J*, 2008, 14, 9135) or 2'-O-TC (Dellinger et al., *J. Am. Chem. Soc.*, 2011, 133, 11540). Ultra-mild (C-Ac, G-Pac, A-Pac) protecting groups are used for all of the nucleobases.

Once the automated oligonucleotide synthesis cycle is completed and the final 5'-O-DMTr group is removed, the synthesis column is taken off the DNA/RNA synthesizer and dried under vacuum. 10 mL solution of 0.5 M 1,5-diazabicyclo[4.3.0]non-5-ene (DBN), 0.25 M N,O-bis(trimethylsilyl)trifluoroacetamide (BSTFA) in ACN is continuously added to the support through the synthesis column for 1 min without stopping the flow using a syringe attached to one end of the synthesis column. The support is then washed with anhydrous ACN and dried under vacuum. Then, the dried support is transferred into an empty screw-cap plastic vial and treated with 10% n-PrNH$_2$ solution in anhydrous pyridine (1.5 mL) at room temperature for 12 h. After that, the solvents are evaporated to dryness and the residue including the solid support is dissolved in 2 mL of water/DMSO (50/50) at pH 5, the support is filtered off and the filtrates are collected, immediately frozen and stored at −80° C. prior to purification.

TABLE E-35

Summary for Oligonucleotide Synthesis on a DNA/RNA Synthesizer ABI 394

| step | reaction | reagent | delivery time (sec) | wait time (sec) |
|---|---|---|---|---|
| 1 | detritylation | 3% TCA in DCM | 3 + 120 + 10 | N. A. |
| 2 | coupling | 0.15 M phosphoramidite in ACN +2 M CMPT in ACN | 7 + 6 | 30 + 600 |
| 3 | capping | 5% Pac$_2$O in THF/2,6-lutidine + 16% NMI in THF | 10 | 20 |
| 4 | oxidation | 1.1 M tert-butyl hydroperoxide in 4:1 dichloromethane:decane | 20 | 110 |

TABLE E-36

Summary for Oligonucleotide Synthesis on a DNA/RNA Synthezier ABI 394

| step | reaction | reagent | delivery time (sec) | wait time (sec) |
|---|---|---|---|---|
| 1 | detritylation | 3% TCA in DCM | 3 + 120 + 10 | N.A. |
| 2 | coupling | 0.15M chiral phosphoramidite in ACN + 2M CMPT in ACN | 8 + 6 | 30 + 900 (2'-OMe RNA) 30 + 600 (DNA) |
| 3 | capping 1 | 5% Pac$_2$O in THF/2,6-lutidine | 30 | 60 |
| 4 | capping 2 | 5% Pac$_2$O in THF/2,6-lutidine + 16% NMI in THF | 30 | 60 |
| 5 | sulfurization | 0.3M S-(2-cyanoethyl) methylthiosulfonate | 15 + 3 × 4 | 120 + 3 × 60 + 300 |

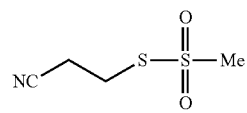

in ACN/BSTFA

TABLE E-37

Summary for Oligonucleotide Synthesis on a DNA/RNA Synthesizer ABI-394.

| step | reaction | reagent | delivery time (sec) | wait time (sec) |
|---|---|---|---|---|
| 1 | detritylation | 3% TCA in DCM | 3 + 60 + 10 | N.A. |
| 2 | coupling | 0.15M phosphoramidite in ACN + 1.2M CMPT in ACN | 5 + 4 | 30 + 600 |
| 3 | capping 1 | 5% Pac$_2$O in THF/2,6-lutidine | 20 | 60 |
| 4 | capping 2 | 5% Pac$_2$O in THF/2,6-lutidine + 16% NMI in THF | 20 | 60 |
| 5 | sulfurization | 0.3M S-(N-morpholinothioester-ethyl-p-nitro-toluylthiosulfonate ... in ACN/BSTFA | 10 + 4 × 2 | 300 + 3 × 150 + 600 |

TABLE E-38

Summary for Oligonucleotide Synthesis on a DNA/RNA Synthesizer ABI-394.

| step | reaction | reagent | delivery time (sec) | wait time (sec) |
|---|---|---|---|---|
| 1 | detritylation | 3% TCA in DCM | 3 + 60 + 10 | N.A. |
| 2 | coupling | 0.15M phosphoramidite in ACN + 1.2M CMPT in ACN | 5 + 4 | 30 + 600 |
| 3 | capping 1 | 5% Pac$_2$O in THF/2,6-lutidine | 20 | 60 |
| 4 | capping 2 | 5% Pac$_2$O in THF/2,6-lutidine + 16% NMI in THF | 20 | 60 |
| 5 | sulfurization | 0.3M S-Morpholinoethyl Toluylthiosulfonate ... in ACN/BSTFA | 10 + 4 × 2 | 300 + 3 × 150 + 600 |

(s10 = )

Synthesis of Oligonucleotide ONT-107: (Rp)-uucuAGAccuGuuuuGcuudTs10dT (SEQ ID NO: 121)

Synthesis of Oligonucleotide: (Sp)-uucuAGAccuGuuuuGcuudTs10dT (SEQ ID NO: 121)

Synthesis of Oligonucleotide ONT-108: (Rp)-AAGcAAAAcAGGUCuAGAAdTs10dT (SEQ ID NO: 122)

Synthesis of Oligonucleotide ONT-109: (Sp)-AAGcAAAAcAGGUCuAGAAdTs10dT (SEQ ID NO: 122)

(s1 = )

```
Synthesis of Oligonucleotide:  (Rp, Rp)-as1AGcAAAAcAGGUCuAGAAdTsdT
                               (SEQ ID NO: 122)

Synthesis of Oligonucleotide:  (Sp, Rp)-as1GcAAAAcAGGUCuAGAAdTsdT
                               (SEQ ID NO: 123)

Synthesis of Oligonucleotide:  (Sp, Sp)-as1GcAAAAcAGGUCuAGAAdTsdT
                               (SEQ ID NO: 123)

Synthesis of Oligonucleotide:  (Rp, Sp)-as1GcAAAAcAGGUCuAGAAdTsdT
                               (SEQ ID NO: 123)

Synthesis of Oligonucleotide:  (All (Sp))-
                               us1ucus1AGAccs1uGus1uus1uGcuudTs10dT
                               (SEQ ID NO: 121)

Synthesis of Oligonucleotide:  (All (Rp))-
                               As10AGcAAAAcAGGs1UCuAs1GAs1AdTs10dT
                               (SEQ ID NO: 122)
```

RNA strand thermal annealing and preparation of siRNA duplexes. Each RNA strand is mixed with its complementary RNA strand in equimolar concentration of 10 µM in 1×PBS. Total 0.5 mL solution is prepared for each duplex and the mixture is heated at 90° C. for 2 min and is allowed to cool down over the course of several hours. The mixtures are then stored at 4° C.

Following the thermal RNA strand annealing step, all the possible siRNA duplex combinations are prepared by annealing any of the Sense strands with any possible complementary strand of the Antisense strands.

All prepared siRNA duplexes are evaluated in vitro for their PCSK9 gene-silencing properties, following transfection in HeLa cells or Hep3B cells.

All prepared siRNA duplexes with ProDrug groups are evaluated in vitro for their PCSK9 gene-silencing properties, following free uptake in Hep3B cells, Huh-7 cells or human primary hepatocytes.

Different potencies are observed, modulated by the number, the position and the stereo architecture of the chiral phosphorothioate backbone linkages, combined with the layers of additional chemical modifications and ProDrug groups explored.

siRNA properties such as: nuclease resistance, cell penetration, endosomal escape, duplex thermodynamic stability, tridemnsional structure of the duplex, affinity towards the various mechanistic steps of enzyme interactions, affinity towards the target mRNA, specific off-target effects, immunestimulation, duration of action, pharmacokinetics, etc. are all modulated and influenced by the stereochemistry of the chiral phosphorothioate backbone linkages as well as the presence or the absence of the ProDrug group.

The attachment of PO and PS releasing ProDrug groups to the siRNA duplexes enhances their intracellular delivery and free uptake in the absence of transfection reagent or targeting ligand.

Example 87: Stability Studies of Diastereomerically Pure Oligonucleotides

The present Example compares the in vitro stability of chirally pure oligonucleotides with that observed for the "parent" stereorandom mixture (i.e., for a composition containing oligonucleotides of the same sequence as the chirally pure oligonucleotides but not displaying chiral purity, for example as a result of having been prepared via a stereorandom process). Seven chirally pure oligonucleotides, each of which had a sequence complementary to that of a particular target transcript or gene encoding a protein of interest were synthesized, formulated, and assessed for metabolic stability using three different biological matrices: snake venom phosphodiesterase (svPDE), nuclease P1 (nP1) and rat whole liver homogenates. Levels of full-length oligonucleotide were quantified by IEX-HPLC after different incubation periods. The results presented in this Example demonstrate, for instance, that chirally pure oligonucleotide compositions can have significantly different metabolic stability as compared with an appropriate reference (e.g., a preparation of oligonucleotides of the same sequence but different chiral specificity, including particularly stereorandom preparations), and specifically as compared with a "parental" stereorandom preparation. In this Example, oligonucleotides having a sequence antisense to (and therefore targeting) human Apolipoprotein-B (ApoB) were used for proof-of-concept in metabolic stability studies.

Snake Venom Phosphodiesterase (svPDE) Digestion Study for Oligonucleotides ONT-75, ONT-77, ONT-80, ONT-81, ONT-87, ONT-88, ONT-89 and ONT-41

Figure 59:
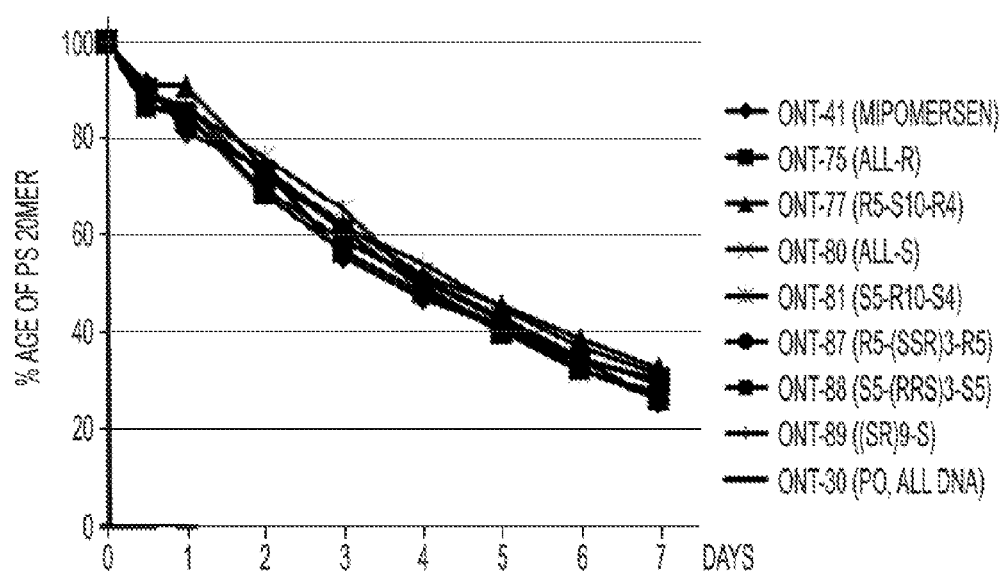
FIG. 59. Plot of IEX-HPLC quantification analysis of svPDE digestion study for oligonucleotides ONT-75, ONT-77, ONT-80, ONT-81, ONT-87, ONT-88, ONT-89 and ONT-41.
Figure 60:
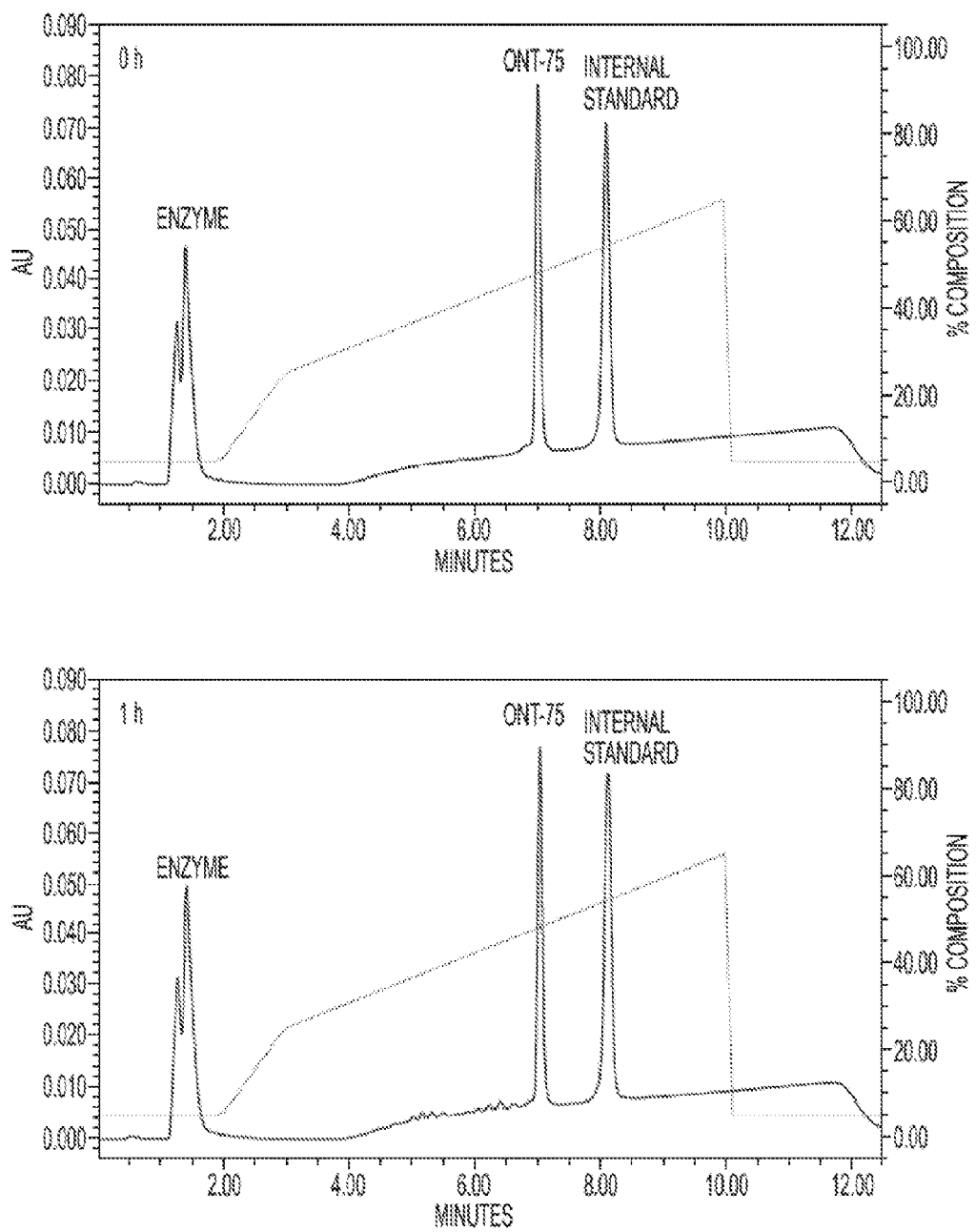
FIG. 60. IEX-HPLC of enzymatic digestion study using nP1 for oligonucleotide ONT-75 (All (Rp))-Gs5mCs5mCsTs5mCsAsGsTs5mCsTsGs5mCsTsTs5mCsGs5mCsAs5mCmCsAs5mCs5mC (SEQ ID NO: 106).
Figure 61:
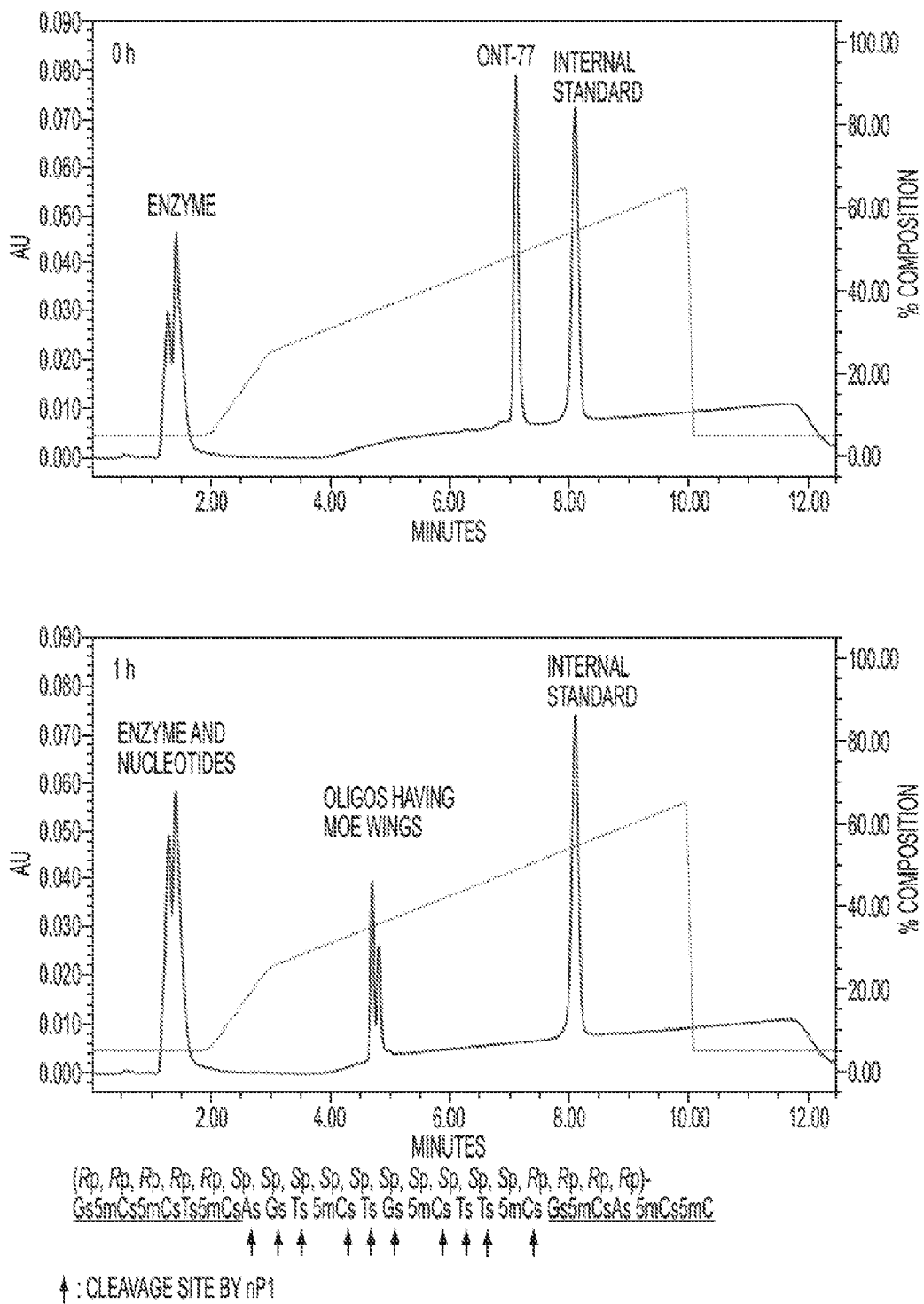
FIG. 61. IEX-HPLC of enzymatic digestion study using nP1 for oligonucleotide ONT-77 (Rp, Rp, Rp, Rp, Rp, Sp, Sp, Sp, Sp, Sp, Sp, Sp, Sp, Sp, Rp, Rp, Rp, Rp)-Gs5mCs5mCsTs5mCsAsGsTs5mCsTsGs5mCsTsTs5mCs Gs5mCsAs5mCs5mC (SEQ ID NO: 106) (5R-10S-4R).
Figure 62:
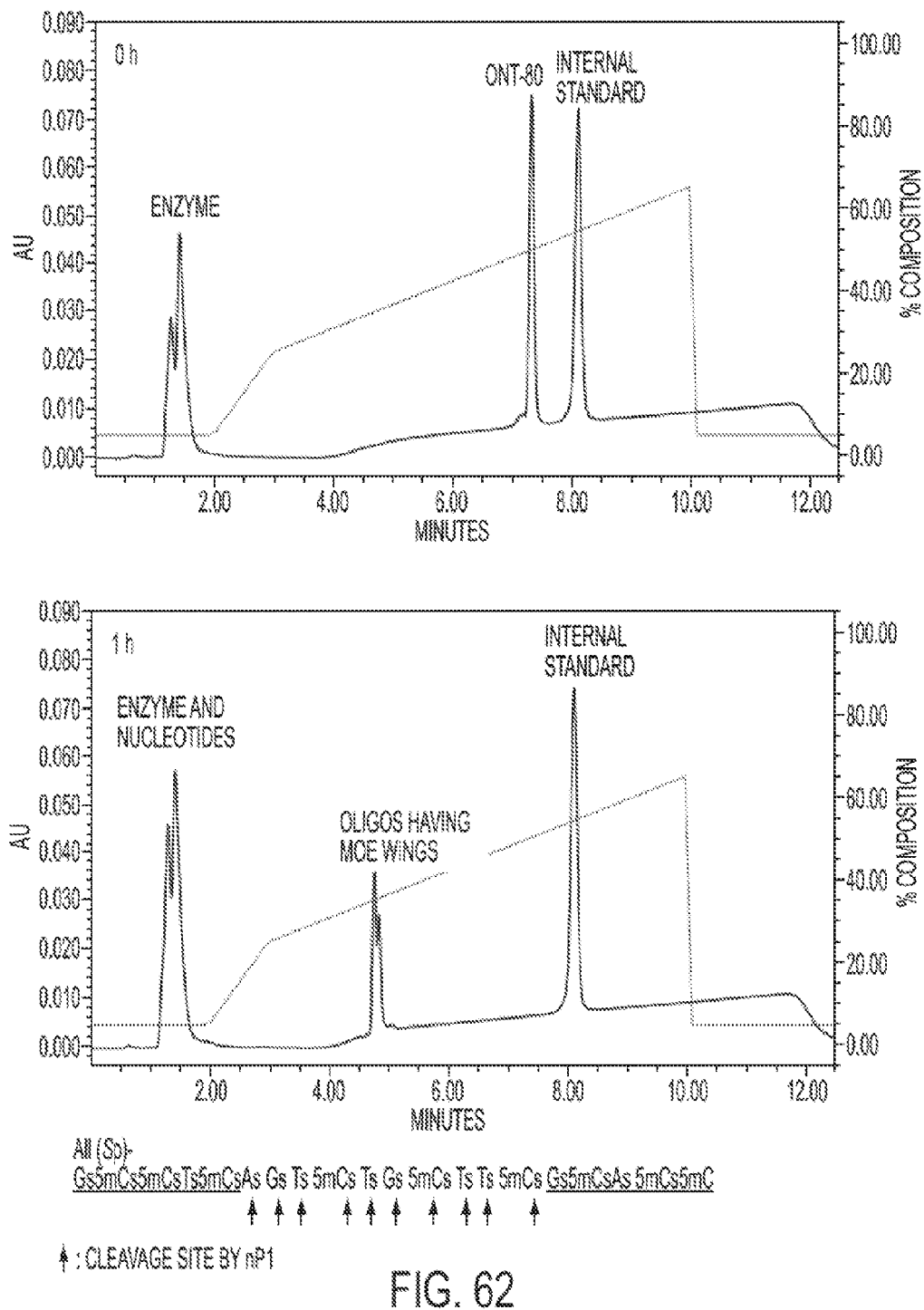
FIG. 62. IEX-HPLC of enzymatic digestion study using nP1 for oligonucleotide ONT-80 (All (Sp))-Gs5mCs5mCsTs5mCsAsGsTs5mCsTsGs5mCsTsTs5mCs Gs5mCsAs5mCs5mC (SEQ ID NO: 106).
Figure 63:
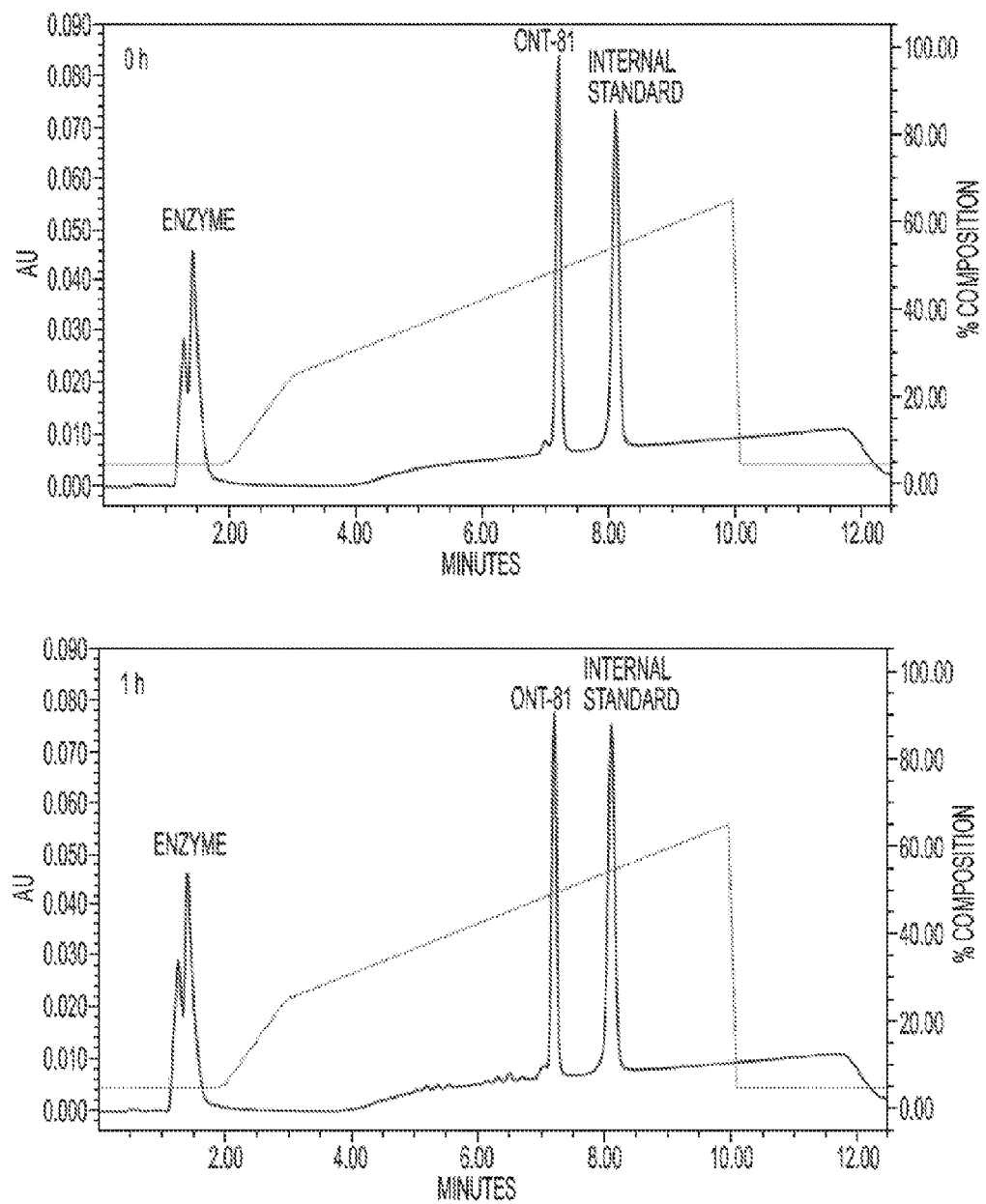
FIG. 63. IEX-HPLC of enzymatic digestion study using nP1 for oligonucleotide ONT-81 (Sp, Sp, Sp, Sp, Sp, Rp, Rp, Rp, Rp, Rp, Rp, Rp, Rp, Rp, Rp, Sp, Sp, Sp, Sp)-Gs5mCs5mCsTs5mCsAsGsTs5mCsTsGs5mCsTsTs5mCs Gs5mCsAs5mCs5mC (SEQ ID NO: 106 (5S-10R-4S).
Figure 64:
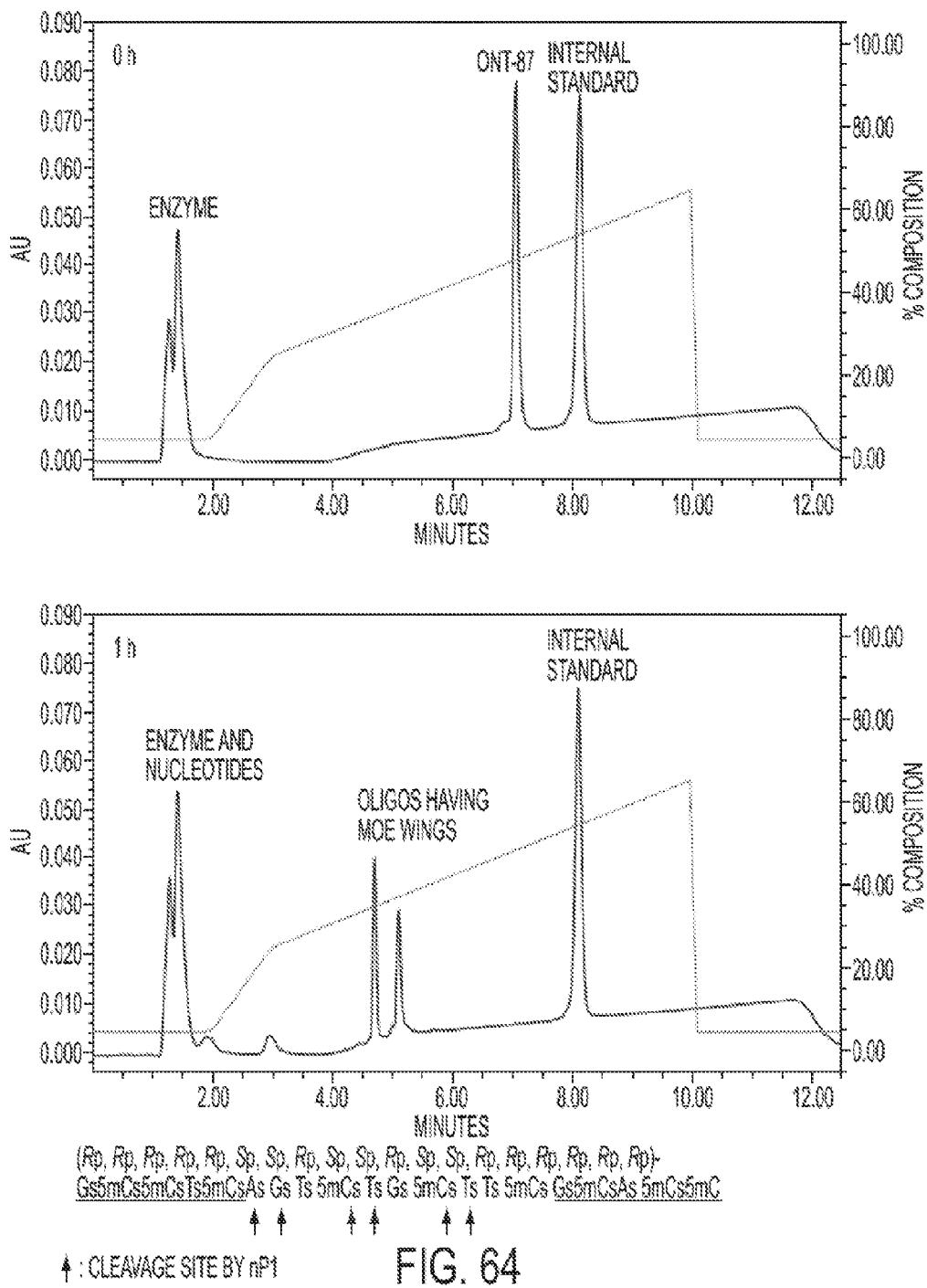
FIG. 64. IEX-HPLC of enzymatic digestion study using nP1 for oligonucleotide ONT-87 (Rp, Rp, Rp, Rp, Rp, Sp, Sp, Rp, Sp, Sp, Rp, Sp, Sp, Rp, Rp, Rp, Rp, Rp, Rp)-Gs5mCs5mCsTs5mCsAsGsTs5mCsTsGs5mCsTsTs5mCs Gs5mCsAs5mCs5mC (SEQ ID NO: 106) (5R—(SSR)$_3$-5R).
Figure 65:
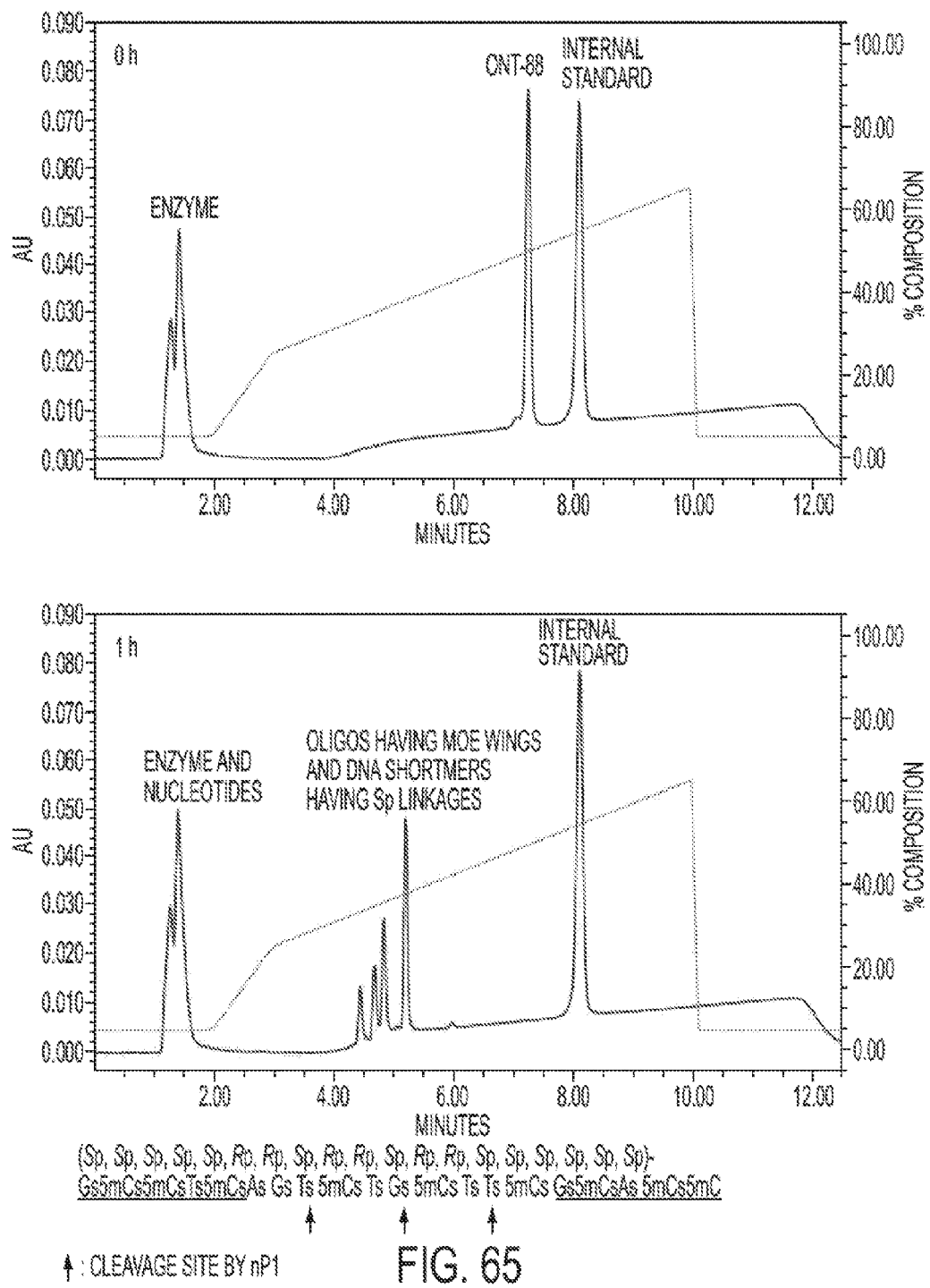
FIG. 65. IEX-HPLC of enzymatic digestion study using nP1 for oligonucleotide ONT-88 (Sp, Sp, Sp, Sp, Sp, Rp, Rp, Sp, Rp, Rp, Sp, Rp, Rp, Sp, Sp, Sp, Sp, Sp, Sp)-Gs5mCs5mCsTs5mCsAsGsTs5mCsTsGs5mCsTsTs5mCs Gs5mCsAs5mCs5mC (SEQ ID NO: 106) (5S—(RRS)$_3$-5S).
Figure 66:
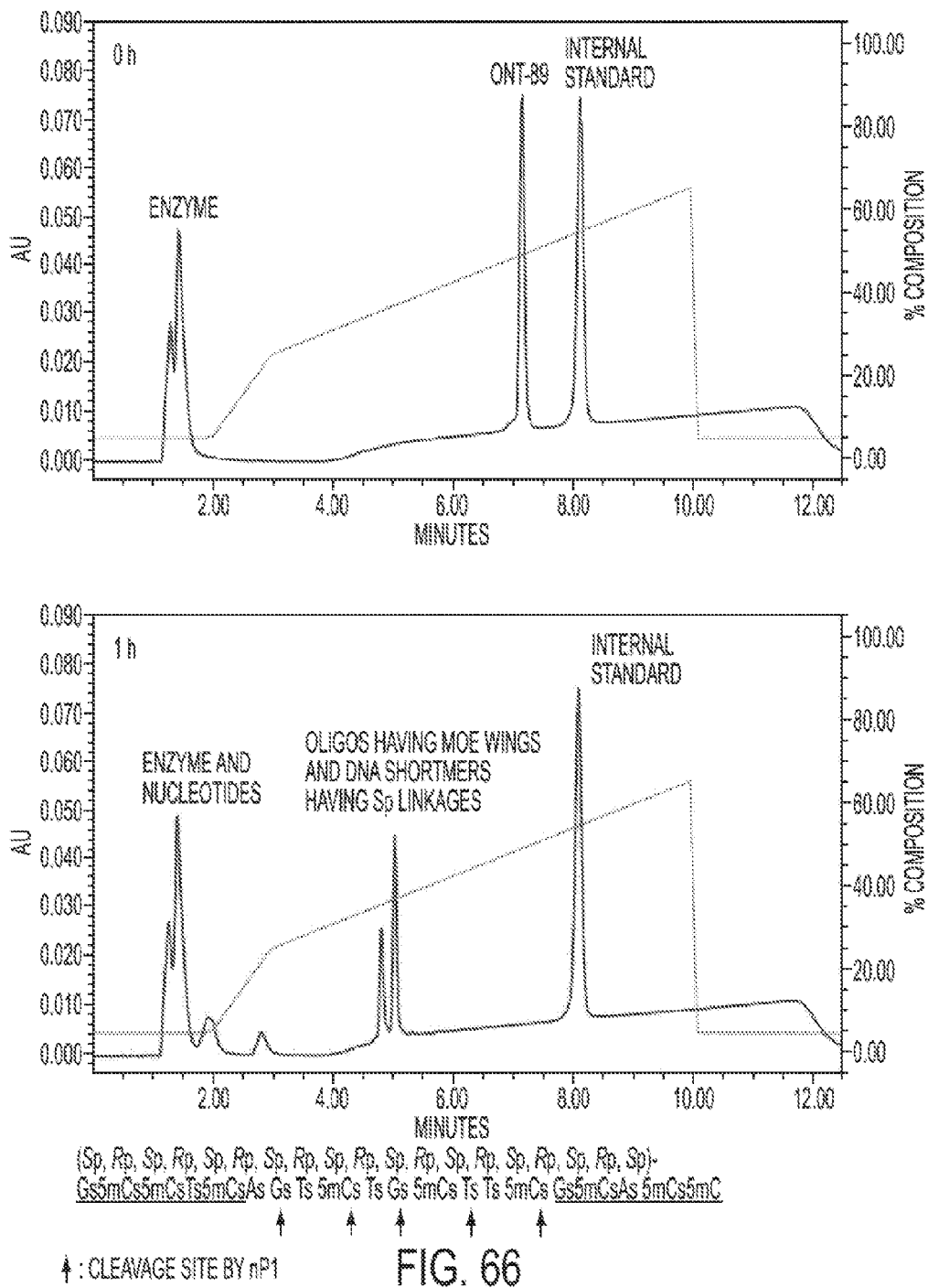
FIG. 66. IEX-HPLC of enzymatic digestion study using nP1 for oligonucleotide ONT-89 (Sp, Rp, Sp, Rp, Sp, Rp, Sp, Rp, Sp, Rp, Sp, Rp, Sp, Rp, Sp, Rp, Sp, Rp, Sp)-Gs5mCs5mCsTs5mCsAsGsTs5mCsTsGs5mCsTsTs5mCs Gs5mCsAs5mCs5mC (SEQ ID NO: 106) ((SR)$_9$S).
Figure 67:
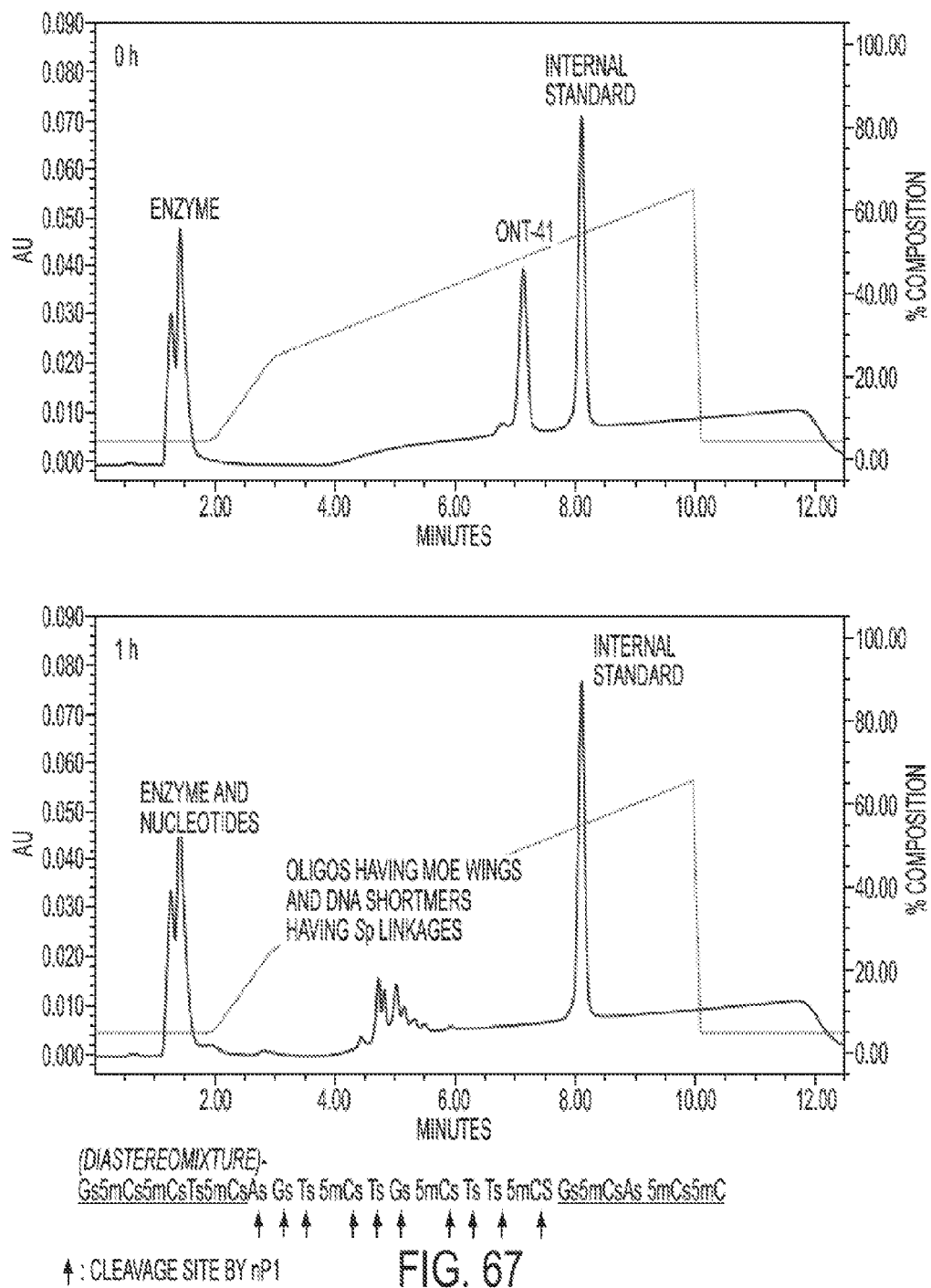
FIG. 67. IEX-HPLC of enzymatic digestion study using nP1 for oligonucleotide ONT-41 (diastereomixture)-Gs5mCs5mCsTs5mCsAsGsTs5mCsTsGs 5mCsTsTs5mCs Gs5mCsAs5mCs5mC (SEQ ID NO: 106).

We used the protocol reported by Oka et al. (*J. Am. Chem. Soc.* 2008, 130, 16031-16037) with minor modifications. Purified oligonucleotide (10 nmoles) in water (50 µL) was added to the aqueous solution (450 µL, pH 8.6) containing svPDE ($4\times10^{-3}$ units), 100 mM Tris-HCl and 15 mM $MgCl_2$. The mixture was incubated at 37° C. with shaking at 400 rpm. A 50 µL aliquot was taken at each time point (0 h, 12 h, 1 d, 2 d, 3 d, 4 d, 5 d, 6 d and 7 d) and was quenched with 25 µL of 150 mM EDTA, 2 µL of Proteinase K solution (20 mg/mL) and 30 µL of Lysis buffer (Qiagen, #129115) and the mixture was heated at 60° C. for 20 min. 5 µL of internal standard (5'-GCGTTTGCTCTTCTTCTT-GCGTTTTTT-3' (SEQ ID NO: 126), a 27-mer oligonucleotide (underlined nucleotides are 2'-MOE modified), (200 µM) was added to the aliquot. Quantification analyses were performed by IEX-HPLC and metabolite identification was carried out by UPLC/MS. The results were illustrated in FIG. 59.

IEX-HPLC analysis showed degradation of phosphorothioate 20-mer during incubation with svPDE with no significant difference between stereoisomers. LCMS analysis of metabolites revealed that the majority of the degradation products were formed as a result of desulfurization. As reported previously by Prakash et al. (*Biochemistry* 2002, 41, 11642-11648), Prhavc et al. (*Org. Lett.*, 2003, 5, 2017-2020) and others, we also observed that 2'-MOE modifications at 5' and 3'-ends protect these oligomers from svPDE digestion which is a 3'→5' exonuclease.

Nuclease P1 (nP1) digestion study for oligonucleotides ONT-75, ONT-77, ONT-80, ONT-81, ONT-87, ONT-88, ONT-89 and ONT-41

We employed the protocol reported by Oka et al. (*J. Am. Chem. Soc.* 2008, 130, 16031-16037) with minor modifications. Purified oligonucleotide (10 nmoles) in Water (50 µL) was added to an aqueous solution (500 µL, pH 7.2) containing nP1 (20 units), 100 mM Tris-HCl and 1 mM $ZnCl_2$. The mixture was incubated at 37° C. with shaking at 400 rpm. A 50 µL aliquot was taken at each time point (0 h, 1 h, 2 h, 4 h, 8 h, 12 h, 1 d, 2 d) and was quenched with 25 µL of stop buffer (150 mM EDTA, 2 µL of Proteinase K solution (20 mg/mL) and 30 µL of Lysis buffer (Qiagen, #129115) and the mixture was heated at 60° C. for 20 min. 5 µL of internal standard (5'-GCGTTTGCTCTTCTTCTT-GCGTTTTTT-3' (SEQ ID NO: 126)), a 27-mer oligonucleotide (underlined nucleotides are 2'-MOE modified) (200 µM) was added to the aliquot. Quantification analyses were performed by IEX-HPLC and metabolite identification was carried out by UPLC/MS. The results were illustrated in FIGS. 60-67.

Nuclease nP1 has previously been reported to specifically cleave DNA phosphorothioate linkages having an (Sp) absolute configuration at the phosphorus atoms (Porter et al., *Biochemistry*, 1983, 22, 1369-1377; Oka et al., *J. Am. Chem. Soc.*, 2008, 130, 16031-16037). We observed a similar pattern of cleavage for the 5-10-5 2'-MOE gapmer phosphorothioate oligonucleotides studied, where nP1 was found to digest efficiently the DNA core of the gapmer oligonucleotides at the (Sp) phosphorothioate centers, without affecting the 2'-MOE wings, which were stable independent of stereochemistry. The complete digestion of the DNA core was observed in one hour for the stereorandom diastereomixture oligonucleotide ONT-41, as well as for the stereopure oligonucleotides containing (Sp)-phosphorothioate internucleotidic linkages in the DNA core (ONT-77, ONT-80, ONT-87, ONT-88 and ONT-89). All products of cleavage were clearly identified by UPLC/MS. As previously reported in the literature, we found that (Rp) phosphorothioate DNA was clearly not a substrate for nP1. The two chirally pure oligonucleotides having (Rp) phosphorothioate DNA cores (ONT-75 and ONT-81) were completely stable to nP1 for an incubation period of 1 h at 37° C. ONT-75 and ONT-81 showed c.a. 10-15% loss of the full length products during the course of incubation over several days. The results presented in this Example demonstrate, for instance, that chirally pure oligonucleotide compositions can have significantly different metabolic stability in an nP1 assay as compared with an appropriate reference (e.g., a preparation of oligonucleotides of the same sequence but different chiral specificity, including particularly stereorandom preparations), and specifically as compared with a "parental" stereorandom preparation.

General IEX-HPLC Method for the Analysis of Enzyme Digestion Products

Buffer A: 10 mM TrisHCl, 50% ACN, pH 8.0

Buffer B: 10 mM TrisHCl, 800 mM $NaClO_4$, 50% ACN, pH 8.0

Column: DIONEX, DNAPac, PA-100, 4.0×250 mm, Part #063000

Column temperature=60° C.

Signal monitored at 254 and 280 nm

Gradient Used:

| Time (min) | Flow (mL/min) | % A | % B | Curve |
|---|---|---|---|---|
| Initial |  | 95 | 5 |  |
| 2 | 1 | 95 | 5 | 1 |
| 3 | 1 | 75 | 25 | 6 |
| 10 | 1 | 35 | 65 | 6 |
| 10.1 | 1 | 95 | 5 | 6 |
| 12.5 | 1 | 95 | 5 | 1 |

General UPLC-LCMS Method for the Analysis of Enzyme Digestion Products.

Buffer A: 15 mM TEA, 400 mM HFIP, Water

Buffer B: 50:50 Buffer A/Methanol

Column: UPLC@OST $Cs_1$ 1.7 µm, 2.1×500 mm

Column temperature=60° C.

Gradient Used:

| Time (min) | Flow (mL/min) | % A | % B | Curve |
|---|---|---|---|---|
| Initial | 0.2 | 70 | 30 |  |
| 2 | 0.2 | 70 | 30 | 1 |
| 27 | 0.2 | 35 | 65 | 6 |
| 27.5 | 0.2 | 5 | 95 | 6 |
| 28.5 | 0.2 | 5 | 95 | 6 |
| 29 | 0.2 | 70 | 30 | 6 |
| 30 | 0.2 | 70 | 30 | 1 |

In Vitro Metabolic Stabilities of Human Diastereomerically Pure Oligonucleotides in Preincubated Rat Whole Liver Homogenates The metabolic stability of chirally pure oligonucleotides in in vitro rat whole liver homogenates was measured. The protocol employed here has previously been reported and used to evaluate the stability of oligonucleotide drugs.

Protocol:

The protocol reported by Geary et al was employed in the current study (Oligonucleotides, 2010, 20, 309) with some modifications.

Test System:

Two male Sprague-Dawley rats (*Rattus norvegicus*) were supplied by Charles River Laboratories, Inc., (Hollister, Calif.).

Tissue Collection:

Animals were acclimated to the study room for two days prior to tissue collection. At the time of tissue collection, animals were anesthetized with an intraperitoneal (IP) injection of sodium pentobarbital solution. Liver perfusion was performed using 500 mL of chilled saline/animal, administered via the hepatic portal vein. After perfusion, the livers were dissected and maintained on ice. Livers were minced into small pieces then weighed.

Liver Homogenate Preparation:

The minced pieces of liver tissues were transferred to tared 50 mL centrifuge tubes and weighed. Chilled homogenization buffer (100 mM Tris pH 8.0, 1 mM magnesium acetate, with antibiotic-antimycotic agents) was added to each tube, such that the tube(s) contained 5 mL of buffer per gram of tissue. Using a QIAGEN TissueRuptor tissue homogenizer, the liver/buffer mixture was homogenized while maintaining the tube on ice. The protein concentration of the liver homogenate was determined using a Pierce BCA protein assay. Liver homogenates were divided into 1 mL aliquots, transferred to cryovials and stored at −60° C.

Incubation Conditions:

1 mL aliquots of frozen liver homogenate (protein concentration=31.9 mg/mL) were thawed and incubated at 37° C. for 24 h. Six eppendorf tubes (2 mL) were taken and 450

μL of homogenate was added in each tube. 50 μL of test oligonucleotide (200 μM) was added to each tube. Immediately after mixing, 125 μL of (5×) stop buffer (2.5% IGEPAL, 0.5 M NaCl, 5 mM EDTA, 50 mM Tris, pH=8.0) and 12.5 μL of 20 mg/mL Proteinase K (Ambion, # AM2546) was added to one tube for a 0 hour time point. The mixture was then heated at 60° C. for one hour. The remaining reaction mixtures were incubated at 37° C. with shaking at 400 rpm on a VWR Incubating Microplate shaker. After incubation for a designated period (1, 2, 3, 4, and 5 days), each mixture was treated with 125 μL of (5×) stop buffer (2.5% IGEPAL, 0.5 M NaCl, 5 mM EDTA, 50 mM Tris, pH=8.0) and 12.5 μL of 20 mg/mL Proteinase K (Ambion, # AM2546).

Work Up and Bioanalysis:

(5'-GCGTTTGCTCTTCTTCTTGCGTTTTTT-3' (SEQ ID NO: 126)), a 27-mer oligonucleotide (underlined nucleotides are 2'-MOE modified) was used as the internal standard for quantitation of diastereomerically pure oligonucleotides. 50 μL of internal standard (200 μM) was added to each tube followed by addition of 250 μL of 30% ammonium hydroxide, 800 μL of Phenol: Chloroform: isoamyl alcohol (25:24:1). After mixing and centrifugation at 600 rpm, the aqueous layer was evaporated on speed vac to 100 μL and loaded on a Sep Pak column (C18, 1 g, WAT 036905). All the aqueous washings of the Sep pak column were tested with quick IEX-HPLC method to ensure that no product was found there. The acetonitrile eluate was concentrated to dryness and dissolved in 100 μL water and analyzed using RP-HPLC.

Eluant A=10 mM Tributylammonium acetate, pH=7.0
Eluant B=ACN
Column: XTerra MS $C_{18}$, 3.5 μm, 4.6×150 mm, Part number: 186000432
Column Temperature=60° C.
HPLC Gradient:

|   | Time | Flow | % A | % B | Curve |
|---|------|------|-----|-----|-------|
| 1 |      | 1.0  | 65  | 35  |       |
| 2 | 5.0  | 1.0  | 65  | 35  | 1     |
| 3 | 30.0 | 1.0  | 40  | 60  | 6     |
| 4 | 35.0 | 1.0  | 5   | 90  | 6     |
| 5 | 36.0 | 1.0  | 65  | 35  | 6     |
| 6 | 40.0 | 1.0  | 65  | 35  | 1     |

Figure 68:
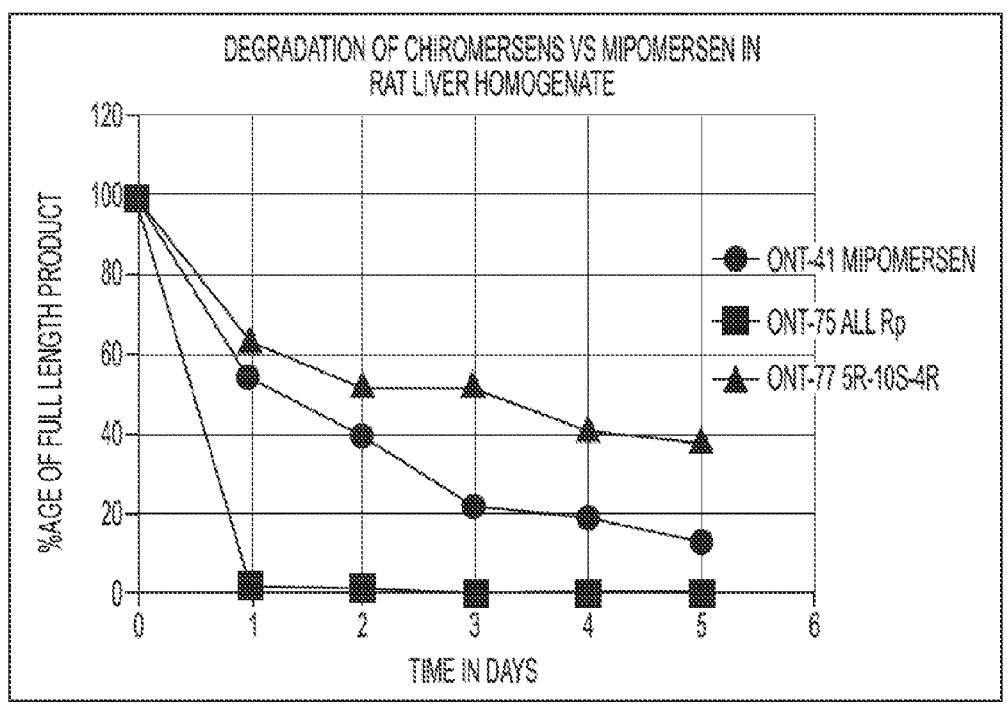
FIG. 68. Comparison of stability of chirally pure oligonucleotides ONT-75 and ONT-77 with the stereorandom "parental" oligonucleotide ONT-41 (Mipomersen) in preincubated rat whole liver homogenate.

FIG. 68 shows that different chirally pure oligonucleotides have different metabolic stability profiles in rat whole liver homogenate. The experiment also demonstrates that the diastereoisomeric mixture ONT-41 has a different metabolic stability profile compared with diastereomerically pure stereodefined oligonucleotides with the same sequence and chemical composition (ONT-75 and ONT-77 are used here as examples, but this observation, as appreciated by a person of ordinary skill in the art, may be extrapolated to other possible diastereomerically pure stereodefined phosphorothioate diastereoisomers of this molecule).

The oligonucleotide ONT-75, having a stereocontrolled phosphorothioate backbone with full Rp absolute configuration at all phosphorus atoms was degraded completely in one day in preincubated rat whole liver homogenates at 37° C., demonstrating the lowest metabolic stability of the three used in the study.

The other diastereomerically pure stereodefined phosphorothioate oligonucleotide ONT-77 (having absolute configuration: 5R-10S-4R) was more than two-fold more stable than the stereorandom ONT-41 (Mipomersen). After incubation for 5 days 40% of full length oligonucleotide remained for the diastereomerically pure ONT-77 vs. approximately 15% of full length oligonucleotide for the stereorandom ONT-41 (Mipomersen). A direct comparison between ONT-77 and ONT-41 clearly demonstrated a significantly higher metabolic stability for the stereocontrolled isomer 5R-10S-4R (ONT-77), throughout all of the analyzed time points. The stereodefined architecture of the diastereomerically pure isomer ONT-77 clearly affects the rate of degradation and the overall metabolic stability of this oligonucleotide. These observations lead to the conclusion, without the intention to be limited by theory, that the Sp stereochemistry applied to the DNA core of the 5-10-5 gapmer oligonucleotide provides enhanced endonuclease resistance and hence enhanced metabolic stability compared with the stereorandom diastereomixture. Some other stereo architectures used for other diastereomerically pure stereocontrolled phosphorothioate isomers of this sequence would be expected to show even higher metabolic stability in this experiment.

While not wishing to be limited by theory, the results presented in this Example demonstrate, for instance, that Rp stereochemistry at the phosphorothioate linkage (ONT-75) is less metabolically stable in rat liver homogenates than ONT-77, which contains the Sp DNA core. The results presented in this Example also demonstrate, for instance, that chirally pure oligonucleotide compositions can have significantly different metabolic stability in rat liver homogenate as compared with an appropriate reference (e.g., a preparation of oligonucleotides of the same sequence but different chiral specificity, including particularly stereorandom preparations), and specifically as compared with a "parental" stereorandom preparation. In this Example, oligonucleotides having a sequence antisense to (and therefore targeting) human Apolipoprotein-B (ApoB) were used for proof-of-concept in metabolic stability studies. A provided chirally controlled oligonucleotides may have increased or decreased stability towards endogenous enzymes. By providing chirally controlled oligonucleotide and compositions and methods thereof, the present invention provided oligonucleotides and compositions that have enhanced pharmacological properties than known chirally uncontrolled oligonucleotides and their compositions.

In Vitro Metabolic Stabilities of Human PCSK9 siRNA Duplexes Having Stereocontrolled Phosphorothioate Diester Linkages in Human Serum.

A protocol similar to previously reported procedures (Oka et al., J. Am. Chem. Soc. 2008, 130, 16031-16037) is used. siRNA duplexes (2.5 μmoles) in water (50 μL) are added to human serum (450 μL). The mixture is incubated at 37° C. with shaking at 400 rpm. 50 μL aliquots are taken out at each time point (0 h, 0.5 h, 1 h, 2 h, 4 h, 6 h, 8 h and 24 h) and are quenched with 25 μL of 150 mM EDTA, 2 μL of Proteinase K solution (20 mg/mL) and 30 μL of Lysis buffer (Qiagen, #129115) and the mixture is heated at 60° C. for 20 min. 5 μL of Internal standard (5'-GCGTT TGCTCTTCTTCTTGCGTTTTTT-3' (SEQ ID NO: 126), a 27-mer oligonucleotide (underlined nucleotides are 2'-MOE modified) (200 μM) is added to the aliquot. Quantification analyses are performed by IEX-HPLC and metabolite identification is carried out by UPLC/MS.

In some embodiments, the siRNA duplexes having a 3' terminal diastereomerically pure phosphorothioate with the Sp configuration show higher metabolic stability in human serum compared to the siRNAs having the phosphorothioate with the Rp configuration, or the stereorandom diastereomixture, at the same position. In other embodiments, the siRNA duplexes having a 5' terminal diastereomerically pure phosphorothioate with the Sp configuration show higher metabolic stability in human serum compared to the siRNAs having the phosphorothioate with the Rp configuration, or the stereorandom diastereomixture, at the same position. In other embodiments, siRNA duplexes having diastereomerically pure phosphorothioates with the Sp configuration at both the 3' and the 5' extremities show higher metabolic stability in human serum compared to the siRNAs having the phosphorothioate with the Rp configuration, or the stereorandom diastereomixtures, at the same positions. In other embodiments, siRNA duplexes having multiple diastereomerically pure phosphorothioates with the Sp configuration show higher metabolic stability in human serum compared to the siRNAs having multiple phosphorothioates with the Rp configuration, or the stereorandom diastereomixtures. In other embodiments, siRNA duplexes having full backbone of diastereomerically pure phosphorothioates with the Sp configuration show higher metabolic stability in human serum compared to the siRNAs having the full backbone of phosphorothioates with the Rp configuration, or the stereorandom diastereomixtures.

Example 88. Chirally Controlled Oligonucleotide Compositions Show Different Potency In Vitro as Compared with Chirally Uncontrolled Compositions Having the Same Sequence The present Example compares in vitro pharmacological activity of chirally pure oligonucleotides with that observed for the "parent" stereorandom mixture (i.e., for a composition containing oligonucleotides of the same sequence as the chirally pure oligonucleotides but not displaying chiral purity, for example as a result of having been prepared via a stereorandom process). Four chirally pure oligonucleotides, each of which had a sequence complementary to that of a particular target transcript or gene encoding a protein of interest were synthesized, formulated, and transfected into primary mouse hepatocytes. mRNA levels were quantified to assess level of suppression. In this Example, oligonucleotides having a sequence antisense to (and therefore targeting) human Apolipoprotein-B (ApoB) were used for proof-of-concept in transgenic mice expressing human ApoB.

Transfection of Mouse Primary Hepatocytes with Oligonucleotides

C57BL6 male mice, 7 weeks of age were used to extract and plate mouse primary hepatocytes in 96-well plates (without overlay) (Celsis/Bioreclamation IVT). Transfection of primary hepatocytes was carried out with lipofectin (Life Technologies, cat. No. 18292-037) using the manufacturer's protocol, using 0.5 ul of Lipofectin per 96-plate well. Twelve, 1:3 siRNA duplex dilutions were created starting at 6 µM. 10 ul of 10× oligo was then lipoplexed with a prepared mixture of 9.5 ul of In vitro Gro HI Medium (Celsis Cat. Z99009) serum-free medium and 0.5 ul of Lipofectin per well. After a 10-15 minute incubation, 20 ul of lipoplexed oligo was added to primary hepatocytes in 80 ul of In vitro Gro HI Medium to bring the final volume to 100 ul per well. 24 hours after transfection, cells were lysed.

Apolipoprotein B mRNA Assay

Total mRNA was purified from cell lysates using MagMAX™-96 Total RNA Isolation Kit (Life Technologies, AM1830); 15 ul of cDNA was synthesized with High Capacity cDNA Reverse Transcription Kit with RNase Inhibitor (Life Technologies, 4374967). Gene expression was evaluated by Real-Time PCR on a Lightcycler 480 (Roche) using a Probes Master Mix (Roche, 04 707 494 001) according to manufacturer's protocol using the following primers:

Mouse Apolipoprotein B Primers:

[Template: (GenBank accession number M35186)]

| | |
|---|---|
| forward primer: | CGTGGGCTCCAGCATTCTA (SEQ ID NO: 127) |
| reverse primer: | AGTCATTTCTGCCTTTGCGTC (SEQ ID NO: 128) |
| PCR probe: | FAM-CCAATGGTCGGGCACTGCTCAA-TAMRA (SEQ ID NO: 129) |

Mouse GAPDH Primers:

| | |
|---|---|
| forward primer: | GGCAAATTCAACGGCACAGT (SEQ ID NO: 130) |
| reverse primer: | GGGTCTCGCTCCTGGAAGAT (SEQ ID NO: 131) |
| PCR probe: | 5' JOE-AAGGCCGAGAATGGGAAG CTTGTCATC-TAMRA 3' (SEQ ID NO: 132) |

Data Analysis

The delta delta Ct method was used to calculate values. For each sample, the mean ApoB signal was normalized to the mean GAPDH signal, and then normalized to the mean corresponding ratio for mock transfected and untreated samples, to obtain the relative level of ApoB protein expression. The "parent" stereorandom mixture was used for reference. A four-parameter linear regression curve was fitted to the data, and the bottom and top were constrained to a 0% and 100% constants respectively in order to calculate a relative IC50 using Graphpad Prism.

Figure 71:
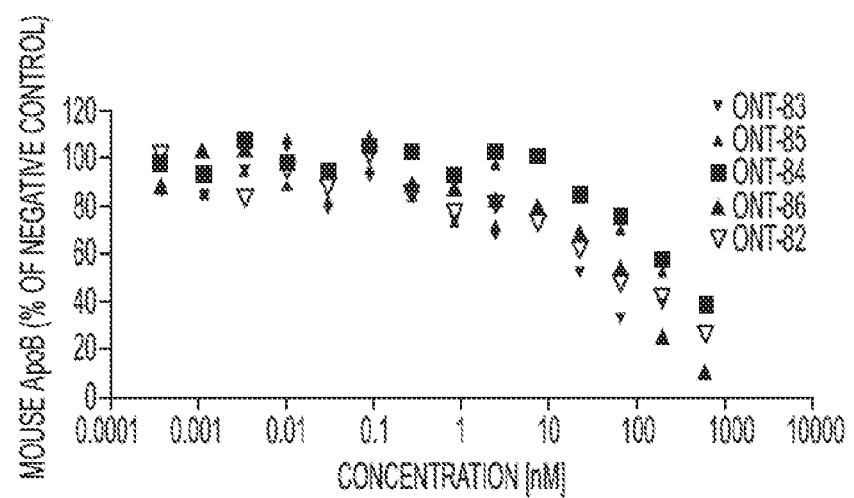
FIG. 71. Mouse Apolipoprotein B/GAPDH mRNA Levels Relative to Mock and Untreated Controls after Transfection of Primary Mouse Hepatocytes with Stereoisomer (ONT-82, ONT-83, ONT-84, ONT-85 or ONT-86).
Figure 72:
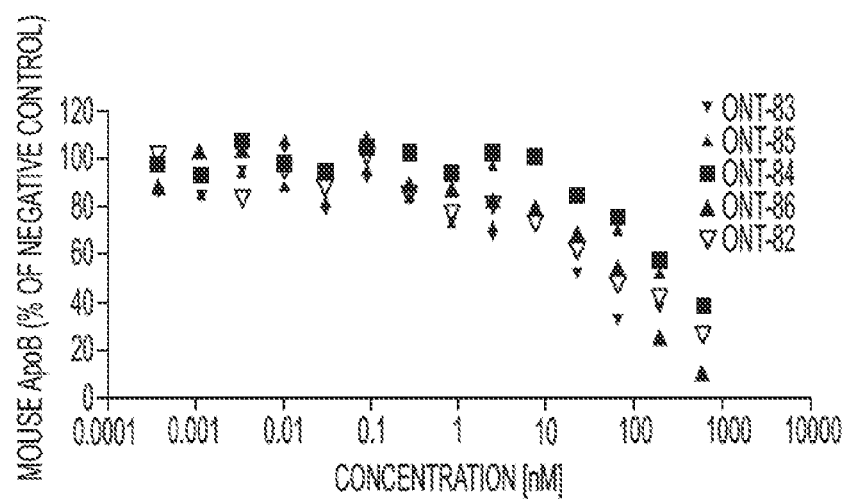
FIG. 72. Mouse Apolipoprotein B/GAPDH mRNA Levels Relative to Mock and Untreated Controls after Transfection of Primary Mouse Hepatocytes with Stereoisomer (ONT-83, ONT-84, ONT-85 or ONT-86).

The in vitro dose-responses (FIGS. 71 and 72) show that the chirally pure oligonucleotides have significantly different potencies, with ONT-83 being the most potent, and ONT-84 and ONT-85 being the least potent, with a 8.6-fold difference in IC50s (Table E-39).

TABLE E-39

IC50 values of Stereoisomers (ONT-83, -84, -85 or -86) for Suppression of Mouse Apolipoprotein B/GAPDH mRNA Levels in Primary Mouse Hepatocytes

| | Bottom | Top | LogIC50 | Hill Slope | IC50 |
|---|---|---|---|---|---|
| ONT-83 | 0 | 100 | 1.6 | −0.4 | 35.8 |
| ONT-82 | 0 | 100 | 1.8 | −0.3 | 64.4 |
| ONT-85 | 0 | 100 | 2.5 | −0.3 | 308.0 |
| ONT-84 | 0 | 100 | 2.5 | −0.8 | 307.8 |
| ONT-86 | 0 | 100 | 1.7 | −0.6 | 51.2 |

The results presented in this Example demonstrate, for instance, that chirally pure oligonucleotide compositions can have significantly different pharmacological activity in vitro as compared with an appropriate reference (e.g., a preparation of oligonucleotides of the same sequence but different chiral specificity, including particularly stereorandom preparations), and specifically as compared with a "parental" stereorandom preparation. Those skilled in the art, in light of this demonstration, will appreciate that chirally controlled oligonucleotide compositions provided by the present disclosure have unexpected activities and characteristics.

EQUIVALENTS

Having described some illustrative embodiments of the invention, it should be apparent to those skilled in the art that the foregoing is merely illustrative and not limiting, having been presented by way of example only. Numerous modifications and other illustrative embodiments are within the scope of one of ordinary skill in the art and are contemplated as falling within the scope of the invention. In particular, although many of the examples presented herein involve specific combinations of method acts or system elements, it should be understood that those acts and those elements may be combined in other ways to accomplish the same objectives. Acts, elements, and features discussed only in connection with one embodiment are not intended to be excluded from a similar role in other embodiments. Further, for the one or more means-plus-function limitations recited in the following claims, the means are not intended to be limited to the means disclosed herein for performing the recited function, but are intended to cover in scope any means, known now or later developed, for performing the recited function.

Use of ordinal terms such as "first", "second", "third", etc., in the claims to modify a claim element does not by itself connote any priority, precedence, or order of one claim element over another or the temporal order in which acts of a method are performed, but are used merely as labels to distinguish one claim element having a certain name from another element having a same name (but for use of the ordinal term) to distinguish the claim elements. Similarly, use of a), b), etc., or i), ii), etc. does not by itself connote any priority, precedence, or order of steps in the claims. Similarly, the use of these terms in the specification does not by itself connote any required priority, precedence, or order.

The foregoing written specification is considered to be sufficient to enable one skilled in the art to practice the invention. The present invention is not to be limited in scope by examples provided, since the examples are intended as a single illustration of one aspect of the invention and other functionally equivalent embodiments are within the scope of the invention. Various modifications of the invention in addition to those shown and described herein will become apparent to those skilled in the art from the foregoing description and fall within the scope of the appended claims. The advantages and objects of the invention are not necessarily encompassed by each embodiment of the invention.

Appendix (A)

| Accession # | Unigene # | Gene Symbol | Name | Sequence | SEQ ID NO: |
|---|---|---|---|---|---|
| NM_003467 | Hs.421986 | CXCR4 | Chemokine (C-X-C motif) receptor 4 | 5'-UAAAAUCUUCCUGCCCACCdTdT-3' | 139 |
| NM_003467 | Hs.421986 | CXCR4 | Chemokine (C-X-C motif) receptor 4 | 5'-GGAAGCUGUUGGCUGAAAAdTdT-3' | 140 |
| NM_006799.2 | Hs.72026 | PRSS21 | Protease, serine, 21 (testisin) | 5'-CACAUCCAGCCCAUCUGUC(dTdT)-3' | 141 |
| NM_000117.1 | Hs.522823 | EMD | Emerin | 5'-CCGUGCUCCUGGGGCUGGG(dTdT)-3' | 142 |
| NM_001350.3 | Hs.336916 | DAXX | Death-associated protein 6 | 5'-GGAGUUGGAUCUCUCAGAA(dTdT)-3' | 143 |
| NM_003014.2 | Hs.105700 | SFRP4 | Secreted frizzled-related protein 4 | 5'-AAGTCCCGCTCATTACAAATT-3' | 144 |
| NM_015062.3 | Hs.533551 | PPRC1 | Peroxisome proliferative activated receptor, gamma, coactivator-related 1 | 5'-AAGACCAGCCUCUUUGCCCAG-3' | 145 |
| NM_001005360.1 | Hs.211463 | DNM2 | Dynamin 2 | 5'-GGACCAGGCAGAAAACGAG-3 | 146 |
| NM_001904.2 | Hs.476018 | CTNNB1 | Catenin (cadherin-associated protein), beta 1, 88 kDa | 5'-CUAUCAGGAUGACGCGG-3' | 147 |
| NM_153831.2 | Hs.395482 | PTK2 | PTK2 protein tyrosine kinase 2 | 5'-AACCACCUGGGCCAGUAUUAU-dTT-3' | 148 |
| NM_001429.2 | Hs.517517 | EP300 | E1A binding protein p300 | 5'-UGACACAGGCAGGCUUGACUU-3' | 149 |
| NM_005904.2 | Hs.465087 | SMAD7 | SMAD, mothers against DPP homolog 7 (Drosophila) | 5' AA GCU CAA UUC GGA CAA CAA G 3' | 150 |
| NM_001904.2 | Hs.476018 | CTNNB1 | Catenin (cadherin-associated protein), beta 1, 88 kDa | 5' AAG UCC UGU AUG AGU GGG AAC 3' | 151 |
| NM_175847.1 | Hs.172550 | PTBP1 | Polypyrimidine tract binding protein 1 | 5'-TCG ACG AAC ATC TAC AAC GCC TGC TTC AAG AGA GCA GGC GTT GTA GAT GTT CTT TTT TT-3' | 152 |
| NM_175847.1 | Hs.172550 | PTBP1 | Polypyrimidine tract binding protein 1 | 5'-TCG ACC AAT GAC AAG AGC CGT GAC TTC AAG AGA GTC ACG GCT CTT GTC ATT GTT TTT TT-3' | 153 |

-continued

| Accession # | Unigene # | Gene Symbol | Name | Sequence | SEQ ID NO: |
|---|---|---|---|---|---|
| NM_002659.2 | Hs.466871 | PLAUR | Plasminogen activator, urokinase receptor | 5'-GGTGAAGAAGGGCGTCCAA-3' | 154 |
| NM_033360.2 | Hs.505033 | KRAS2 | V-Ki-ras2 Kirsten rat sarcoma 2 viral oncogene homolog | 5'-GATCCGTTGGAGCTGTTGGCGTAG TTCAAGAGACTACGCCA ACAGCTCCAACTTTTTGGAAA-3' | 155 |
| NM_002959.4 | Hs.485195 | SORT1 | Sortilin 1 | 5'-AGGTGGTGTTAACAGCAGAG-3' | 156 |
| NM_002959.4 | Hs.485195 | SORT1 | Sortilin 1 | 5'-AATGTTCCAATGCCCCACTC-3' | 157 |
| NM_000743.2 | Hs.89605 | CHRNA3 | Cholinergic receptor, nicotinic, alpha polypeptide 3 | 5'-AACUGCCAGUGGCCAGGGCCU-3' | 158 |
| NM_004859.2 | Hs.491351 | CLTC | Clathrin, heavy polypeptide (Hc) | 5'-AACCUGCGGUCUGGAGUCAAC-3' | 159 |
| NM_004859.2 | Hs.491351 | CLTC | Clathrin, heavy polypeptide (Hc) | 5'-UAAUCCAAUUCGAAGACCAAU-3' | 160 |
| NM_000038.3 | Hs.158932 | APC | Adenomatosis polyposis coli | 5'-AGGGGCAGCAACTGATGAAAA-3' | 161 |
| NM_004850.3 | Hs.58617 | ROCK2 | Rho-associated, coiled-coil containing protein kinase 2 | 5'-AAGGCATCGCAGAAGGTTTAT-3' | 162 |
| NM_001274.2 | Hs.24529 | CHEK1 | CHK1 checkpoint homolog (S. pombe) | 5'-UCGAAGUACUCAGCGUAAG-3' | 163 |
| NM_007194.3 | Hs.291363 | CHEK2 | CHK2 checkpoint homolog (S. pombe) | 5'-GAACCUGAGGACCAAGAAC-3' | 164 |
| NM_001901.1 | Hs.410037 | CTGF | Connective tissue growth factor | 5'-AATGTTCTCTTCCAGGTCAGCCCTGTC TC-3' | 165 |
| NM_001619.2 | Hs.83636 | ADRBK1 | Adrenergic, beta, receptor kinase 1 | 5'-AAGAAGUACGAGAAGCUGGAG-3' | 166 |
| NM_005160.2 | Hs.517493 | ADRBK2 | Adrenergic, beta, receptor kinase 2 | 5'-AAGCAAGCUGUAGAACACGUA-3' | 167 |
| NM_005308.2 | Hs.524625 | GRK5 | G protein-coupled receptor kinase 5 | 5'-AAGCCGUGCAAAGAACUCUUU-3' | 168 |
| NM_001004106.1 | Hs.235116 | GRK6 | G protein-coupled receptor kinase 6 | 5-AACAGUAGGUUUGUAGUGAGC-3' | 169 |
| NM_017556.1 | Hs.530101 | FBLP-1 | Filamin-binding LIM protein-1 | 5'-AAAGGGGCAUCCACAGACAUC-3' | 170 |
| NM_005857.2 | Hs.132642 | ZMPSTE24 | Zinc metallopeptidase (STE24 homolog, yeast) | 5'-TTAT TCTTCTCTTT GGAGGA-3' | 171 |
| NM_005572 | Hs.491359 | LMNA | Lamin A/C | 5'-ACTGGACTTC CAGAAGAAC-3' | 172 |
| NM_015878.3 | Hs.459106 | OAZIN | Ornithine decarboxylase antizyme inhibitor | 5'-AATTGCACGTAATCACCCAAA-3' | 173 |
| NM_015878.3 | Hs.459106 | OAZIN | Ornithine decarboxylase antizyme inhibitor | 5'-AAGAAATACAAGGAAGATGAG-3' | 174 |
| NM_001664.2 | Hs.247077 | RHOA | Ras homolog gene family, member A | 5'-GACAUGCUUGCUCAUAGUCUU-3' | 175 |
| NM_175744.3 | Hs.502659 | RHOC | Ras homolog gene family, member C | 5'-GACCUGCCUCCUCAUCGUCUU-3' | 176 |
| NM_000041.2 | Hs.515465 | APOE | Apolipoprotein E | 5'-AAGGTGGAGCAAGCGGTGGAG-3' | 177 |
| NM_000041.2 | Hs.515465 | APOE | Apolipoprotein E | 5'-AAGGAGTTGAAGGCCTACAAA-3' | 178 |
| AF520590.1 | Hs.536600 | BAK1 | BCL2-antagonist/killer 1 | 5'-UGCCUACGAACUCUUCACCdTdT-3' | 179 |
| NM_138761.2 | Hs.159428 | BAX | BCL2-associated X protein | 5'-UAUGGAGCUGCAGAGGAUGdTdT-3' | 180 |

-continued

| Accession # | Unigene # | Gene Symbol | Name | Sequence | SEQ ID NO: |
|---|---|---|---|---|---|
| NM_005733.1 | Hs.73625 | iKIF20A | Kinesin family member 20A | 5'-TTGGCCAAGCCACACACAG-3' | 181 |
| NM_005733.1 | Hs.73625 | KIF20A | Kinesin family member 20A | 5'-GTTCTCAGCCATTGCTAGC-3' | 182 |
| NM_005733.1 | Hs.73625 | KIF20A | Kinesin family member 20A | 5'-GGCAGCATGTATTGCTGAG-3' | 183 |
| NM_014034.1 | Hs.292316 | ASF1A | ASF1 anti-silencing function 1 homolog A (*S. cerevisiae*) | 5'-AAUC CAGGACUCAUUCCAGAU-3' | 184 |
| NM_014034.1 | Hs.292316 | ASF1A | ASF1 anti-silencing function 1 homolog A (*S. cerevisiae*) | 5'-AAGUGAAGAAUACGAUCAAGU-3' | 185 |
| NM_018154.1 | Hs.26516 | ASF1B | ASF1 anti-silencing function 1 homolog B (*S. cerevisiae*) | 5'-AACAACGAGUACCUCAACCCU-3' | 186 |
| NM_022110.3 | Hs.520042 | WISp39 | FK506 binding, protein like | 5'AACGCUUGAGCUGGAAGUAAG 3' | 187 |
| NM_022110.3 | Hs.520042 | WISp39 | FK506 binding protein like | 5'-CCUUCAAGCUUCUGAUCUC-3' | 188 |
| NM_000389.2 | Hs.370771 | CDKN1A | Cyclin-dependent kinase inhibitor 1A (p21, Cip1) | 5'-AACUUCGACUUUGUCACCGAG-3' | 189 |
| NM_004064.2 | Hs.238990 | CDKN1B | Cyclin-dependent kinase inhibitor 1B (p27, Kip1) | 5'-AAGCACUGCAGAGACAUGGAAG-3' | 190 |
| NM_033084.2 | Hs.208388 | FANCD2 | Fanconi anemia, complementation group D2 | 5'-AACAGCCATGGATACACTTGA-3' | 191 |
| NM_001641.2 | Hs.73722 | APEX1 | APEX nuclease (multifunctional DNA repair enzyme) 1 | 5'-AATGACAAAGAGGCAGCAGG-3- | 192 |
| NM_001641.2 | Hs.73722 | APEX1 | APEX nuclease (multifunctional DNA repair enzyme) 1 | 5'-AACCTGCCACACTCAAGATC-3' | 193 |
| NM_001641.2 | Hs.73722 | APEX1 | APEX nuclease (multifunctional DNA repair enzyme) 1 | 5'-AGCTGAACTTCAGGAGCTGCC-3' | 194 |
| NM_001641.2 | Hs.73722 | APEX1 | APEX nuclease (multifunctional DNA repair enzyme) 1 | 5'-AAGCCTTTCGCAAGTTCCTGA-3' | 195 |
| NM_001641.2 | Hs.73722 | APEX1 | APEX nuclease (multifunctional DNA repair enzyme) 1 | 5'-ACGGCATAGGCGATGAGGAG-3' | 196 |
| NM_001641.2 | Hs.73722 | APEX1 | APEX nuclease (multifunctional DNA repair enzyme) 1 | 5'-AGGAAGGCCGGGTGATTGTG-3' | 197 |
| NM_001641.2 | Hs.73722 | APEX1 | APEX nuclease (multifunctional DNA repair enzyme) 1 | 5'-GTCTGGTACGACTGGAGTA-3' | 198 |
| NM_001641.2 | Hs.73722 | APEX1 | APEX nuclease (multifunctional DNA repair enzyme) 1 | 5'-GACAGCTTTAGGCACCTCTA-3' | 199 |
| NM_015641.2 | Hs.533391 | TES | Testis derived transcript (3 LIM domains) | 5'-GGAUUCGAACUGCACUUCU-3' | 200 |
| NM_015641.2 | Hs.533391 | TES | Testis derived transcript (3 LIM domains) | 5'-ACUGUGGCACCCAGCUUGU-3' | 201 |
| NM_003461.3 | Hs.490415 | ZYX | Zyxin | 5'-GCCCAAAGUGAAUCCCUUC-3' | 202 |
| NM_002880.2 | Hs.159130 | RAF1 | V-raf-1 murine leukemia viral oncogene homolog 1 | 5'-TTTGAATATCTGTGCTGAGAACACA GTTCTCAGCACAGATATTCTTTTT-3' | 203 |
| NM_002880.2 | Hs.159130 | RAF1 | V-raf-1 murine leukemia viral oncogene homolog 1 | 5'-TTTGTCAATTAGCTGGAACATCACAG TGTTCCAGCTAATTGACTTTTT-3' | 204 |

-continued

| Accession # | Unigene # | Gene Symbol | Name | Sequence | SEQ ID NO: |
|---|---|---|---|---|---|
| NM_004506.2 | Hs.158195 | HSF2 | Heat shock transcription factor 2 | 5'-AATGAGAAAAGCAAAAGGTGCCCTGTCTC-3' | 205 |
| NM_005356.2 | Hs.470627 | LCK | Lymphocyte-specific protein tyrosine kinase | 5'-CAUCGAUGUGUGUGAGAACUGC-3' | 206 |
| NM_005546.3 | Hs.483938 | ITK | IL2-inducible T-cell kinase | 5'-CUGUUCUCAGCUGGAGAAGCUU-3' | 207 |
| NM_005546.3 | Hs.483938 | ITK | IL2-inducible T-cell kinase | 5'-GGAGCCUUCAUGGUAAGGGAUU-3' | 208 |
| NM_002133.1 | Hs.517581 | HMOX1 | Heme oxygenase (decycling) 1 | 5'-GGCACCATGAAGGCG-3' | 209 |
| NM_000639.1 | Hs.2007 | FASLG | Tumor necrosis factor (ligand) superfamily, member 6 | 5'-CUGGGCU GUACU UUGUA UAUU-3' | 210 |
| NM_018417.2 | Hs.320892 | SAC | Testicular soluble adenylyl cyclase | 5'-AUGUAGCCUGGAGAUCCAUUU-3' | 211 |
| NM_003743.3 | Hs.412293 | NCOA1 | Nuclear receptor coactivator 1 | 5'-CCUCAGGGCAGAGAACCAUCUdTdT-3' | 212 |
| NM_005572.2 | Hs.491359 | LMNA | Lamin A/C | 5'-CUGGACUUCCAGAAGAACAUCdTdT-3' | 213 |
| NM_176871.2 | Hs.521444 | PDLIM2 | PDZ and LIM domain 2 (mystique) | 5'-AAGAUCCGCCAGAGCCCCUCG-3' | 214 |
| NM_014188.2 | Hs.30026 | HSPC182 | HSPC182 protein | 5'-AACAGGGACTCACGTGAAGCT-3' | 215 |
| NM_014188.2 | Hs.30026 | HSPC182 | HSPC182 protein | 5'-AAGACCTGTTTGATCTGATCC-3' | 216 |
| AF263744.1 | Hs.519346 | ERBB2IP | Erbb2 interacting protein | 5'-UAGACUGACCCAGCUGGAAdTdT-3' | 217 |
| NM_002583.2 | Hs.406074 | PAWR | PRKC, apoptosis, WT1, regulator | 5'-GAUGCAAUUACACAACAGAdTdT-3' | 218 |
| NM_003766.2 | Hs.12272 | BECN1 | Beclin 1 (coiled-coil, myosin-like BCL2 interacting protein) | 5'-CUCAGGAGAGGAGCCAUUU-3' | 219 |
| NM_003766.2 | Hs.12272 | BECN1 | Beclin 1 (coiled-coil, myosin-like BCL2 interacting protein) | 5'-GAUUGAAGACACAGGAGGC-3' | 220 |
| NM_004849.1 | Hs.486063 | APG5L | APG5 autophagy 5-like (S. cerevisiae) | 5'-GCAACUCUGGAUGGGAUUG-3' | 221 |
| NM_031482.3 | Hs.527193 | APG10L | APG10 autophagy 10-like (S. cerevisiae) | 5'-GGAGUUCAUGAGUGCUAUA-3' | 222 |
| NM_004707.2 | Hs.264482 | APG12L | APG12 autophagy 12-like (S. cerevisiae) | 5'-CAGAGGAACCUGCUGGCGA-3' | 223 |
| NM_002613.2 | Hs.459691 | PDPK1 | 3-phosphoinositide dependent protein kinase-1 | 5'-AACTGGCAACCTCCAGAGAAT-3' | 224 |
| NM_002613.2 | Hs.459691 | PDPK1 | 3-phosphoinositide dependent protein kinase-1 | 5'-AAGAGACCTCGTGGAGAAACT-3' | 225 |
| NM_000314.2 | Hs.500466 | PTEN | Phosphatase and tensin homolog (mutated in multiple advanced cancers 1) | 5'-AACAGTAGAGGAGCCGTCAAA-3' | 226 |
| NM_006092.1 | Hs.405153 | CARD4 | Caspase recruitment domain family, member 4 | 5'-GGGUGAGACCAUCUUCAUCUU-3' | 227 |
| NM_006092.1 | Hs.405153 | CARD4 | Caspase recruitment domain family, member 4 | 5'-GGCCAAAGUCUAUGAAGAUUU-3' | 228 |
| NM_000598.3 | Hs.450230 | IGFBP3 | Insulin-like growth factor binding protein 3 | 5'-AAUCAUCAUCAAGAAAGGGCA-3' | 229 |
| NM_006839.1 | Hs.148559 | IMMT | Inner membrane protein, mitochondrial (mitofilin) | 5'-AAUUGCUGGAGCUGGCCUUTT-3' | 230 |
| NM_016485.3 | Hs.431367 | C6ORF55 | Chromosome 6 open reading frame 55 | 5'-GAATGAAGATCGATAGTAA-3' | 231 |

-continued

| Accession # | Unigene # | Gene Symbol | Name | Sequence | SEQ ID NO: |
|---|---|---|---|---|---|
| NM_016485.3 | Hs.431367 | C6ORF55 | Chromosome 6 open reading frame 55 | 5'-GCACAGGTGTAGCAAGTAA-3' | 232 |
| NM_016485.3 | Hs.431367 | C6ORF55 | Chromosome 6 open reading frame 55 | 5'-GGAGAATTATGCTTTGAAA-3' | 233 |
| NM_016485.3 | Hs.431367 | C6ORF55 | Chromosome 6 open reading frame 55 | 5'-GCAGTGCTTTGCAGTATGA-3' | 234 |
| NM_016410.2 | Hs.415534 | SNF7DC2 | SNF7 domain containing 2 | 5'-CAGAAAGCCTTGCGAGTTT-3' | 235 |
| NM_016410.2 | Hs.415534 | SNF7DC2 | SNF7 domain containing 2 | 5'-GAATTTGGATTGCCACAGA-3' | 236 |
| NM_016410.2 | Hs.415534 | SNF7DC2 | SNF7 domain containing 2 | 5'-GAAGGTGTTCCCACTGATA-3' | 237 |
| NM_016410.2 | Hs.415534 | SNF7DC2 | SNF7 domain containing 2 | 5'-GAGAGGGTCCTGCAAAGAA-3' | 238 |
| NM_199185.1 | Hs.519452 | NPM1 | Nucleophosmin (nucleolar phosphoprotein B23, numatrin) | 5'-UGAUGAAAAUGAGCACCAG-3' | 239 |
| NM_003118.2 | Hs.111779 | SPARC | Secreted protein, acidic, cysteine-rich | 5-AAAATCCCTGCCAGAACCACC-3' | 240 |
| NM_003118.2 | Hs.111779 | SPARC | Secreted protein, acidic, cysteine-rich | 5-AACAAGACCTTCGACTCTTCC-3' | 241 |
| NM_003183.3 | Hs.404914 | ADAM17 | A disintegrin and metalloproteinase domain 17 (tumor necrosis factor, alpha, converting enzyme) | 5'-AAACGAAAGCGAGTACACT-3' | 242 |
| NM_012164.2 | Hs.494985 | FBXW2 | F-box and WD-40 domain protein 2 | 5'-AGATGGACTTCTCTGTACAGG-3' | 243 |
| NM_012164.2 | Hs.494985 | FBXW2 | F-box and WD-40 domain protein 2 | 5'-GACATTGTCTGTCTCTGAGGA-3' | 244 |
| NM_175940.1 | Hs.272813 | DUOX1 | Dual oxidase 1 | 5'-GGACUUAUCCUGGCUAGAGtt-3' | 245 |
| NM_004503.2 | Hs.820 | HOXC6 | Homeo box C6 | 5' CCGGAUCUACUCGACUCCCUU 3' | 246 |
| NM_004503.2 | Hs.820 | HOXC6 | Homeo box C6 | 5' CCUAAUCACACACUCUGUAUU 3' | 247 |
| NM_004503.2 | Hs.820 | HOXC6 | Homeo box C6 | 5' ACUGCAGACAAAACACCUUUU 3' | 248 |
| NM_004503.2 | Hs.820 | HOXC6 | Homeo box C6 | 5' UCCAACCUCUGGGUCCGUUUU 3' | 249 |
| NM_004503.2 | Hs.820 | HOXC6 | Homeo box C6 | 5' ACUGUGACCGUUUCUGUGUUU 3' | 250 |
| NM_004503.2 | Hs.820 | HOXC6 | Homeo box C6 | 5' CUCAGACUCUACAGAUUGCUU 3' | 251 |
| NM_182965.1 | Hs.68061 | SPHK1 | Sphingosine kinase 1 | 5'-GGG CAA GGC CUU GCA GCU C-3' | 252 |
| NM_003329.2 | Hs.435136 | TXN | Thioredoxin | 5'-AUGACUGUCAGGAUGUUGCdT-3' | 253 |
| NM_003329.2 | Hs.435136 | TXN | Thioredoxin | 5'-GCAACAUCCUGACAGUCAUdCC-3' | 254 |
| NM_203500.1 | Hs.465870 | KEAP1 | Kelch-like ECH-associated protein 1 | 5'-UGAACGGUGCUGUCAUGUAdTdT-3' | 255 |
| NM_005239.4 | Hs.517296 | ETS2 | V-ets erythroblastosis virus E26 oncogene homolog 2 (avian) | 5'-GCAGAGGUUCGGCAUGAAUdTdT-3' | 256 |
| NM_002067.1 | Hs.515056 | GNA11 | Guanine nucleotide binding protein (G protein), alpha 11 (Gq class) | 5'-AAGATGTTCGTGGACCTGAAC-3' | 257 |
| NM_004827.1 | Hs.480218 | ABCG2 | ATP-binding cassette, sub-family G (WHITE), member 2 | 5'-AAGATGATTGTTCGTCCCTGCTAT AGTGAGTCGTATTA-3' | 258 |
| NM_000610.3 | Hs.502328 | CD44 | CD44 antigen (homing function and Indian blood group system) | 5'-GAACGAAUCCUGAAGACAUCU-3' | 259 |

| Accession # | Unigene # | Gene Symbol | Name | Sequence | SEQ ID NO: |
|---|---|---|---|---|---|
| NM_003489.1 | Hs.155017 | NRIP1 | Nuclear receptor interacting protein 1 | 5'-GAAGGAAGCUUUGCUAGCU-3' | 260 |
| NM_004995.2 | Hs.2399 | MMP14 | Matrix metalloproteinase 14 | 5'-AAGCCTGGCTACAGCAATATGCCTGT CTC-3' | 261 |
| NM_022045.2 | Hs.546363 | MTBP | Mdm2, transformed 3T3 cell double minute 2, p53 binding protein (mouse) binding protein, 104 kDa | 5' GGCUCAUUUGCACUCAAUU 3' | 262 |
| NM_002392.2 | Hs.369849 | MDM2 | Mdm2, transformed 3T3 cell double minute 2, p53 binding protein (mouse) | 5' GCCACAAAUCUGAUAGUAU 3' | 263 |
| NM_170707.1 | Hs.491359 | LMNA | Lamin A/C | 5' CUGGACUUCCAGAAGAACA 3' | 264 |
| NM_004759.3 | Hs.519276 | MAPKAPK2 | Mitogen-activated protein kinase-activated protein kinase 2 | 5'-UGACCAUCACCGAGUUUAUdTdT-3' | 265 |
| NM_001948.2 | Hs.527980 | DUT | DUTP pyrophosphatase | 5'-GATTATAGGAAATGTTG-3' | 266 |
| NM_016022.1 | Hs.108408 | APH-1A | Likely ortholog of C. elegans anterior pharynx defective 1A | 5'-AAGAAGGCAGATGAGGGGTTA-3' | 267 |
| NM_031301.2 | Hs.511703 | PSFL | Anterior pharynx defective 1B-like | 5'-AACAAAGATGGACCAACACAG-3' | 268 |
| BC007496.1 | Bs.36915 | SMAD3 | SMAD, mothers against DPP homolog 3 (Drosophila) | 5'-GGACGAGGUCUGCGUGAAUdTdT-3' | 269 |
| NM_182763.1 | Hs.532826 | MCL1 | Myeloid cell leukemia sequence 1 (BCL2-related) | 5'-AAGAAACGCGGUAAUCGGACU-3' | 270 |
| NM_001022.3 | Hs.438429 | RPS19 | Ribosomal protein S19 | 5'-GCACAAAGAGCTTGCTCCCttcaagaga GGGAGCAAGCTCTTTGTGC-3' | 271 |
| NM_001022.3 | Hs.438429 | RPS19 | Ribosomal protein S19 | 5'-GTCCGGGAAGCTGAAAGTCttcaagaga GACTTTCAGCTTCCCGGAC-3' | 272 |
| NM_001022.3 | Hs.438429 | RPS19 | Ribosomal protein S19 | 5'-GAGATCTGGACAGAATCGCttcaagaga GCGATTCTGTCCAGATCTC-3' | 273 |
| NM_001400.2 | Hs.154210 | EDG1 | Endothelial differentiation sphingolipid G-protein-coupled receptor, 1 | 5'-GGAGAACAGCATTAAACTG-3' | 274 |
| NM_001001938.1 | Hs.546252 | C9orf47 | Chromosome 9 open reading frame 47 | 5'-GGTCAACATTCTGATGTCT-3' | 275 |
| NM_021972.2 | Hs.68061 | SPHK1 | Sphingosine kinase 1 | 5'-GGGCAAGGCCTTGCAGCTC-3' | 276 |
| NM_016068.1 | Hs.423968 | TTC11 | Tetratricopeptide repeat domain 11 | 5'-GTACAATGATGACATCCGTAA-3' | 277 |
| NM_016068.1 | Hs.423968 | TTC11 | Tetratricopeptide repeat domain 11 | 5'-GTACGTCCGCGGGTTGCTGCA-3' | 278 |
| NM_153831.2 | Hs.395482 | PTK2 | PTK2 protein tyrosine kinase 2 | 5'-AAGCAUGUGGCCUGCUAUGGA-3' | 279 |
| NM_003749.2 | Hs.442344 | IRS2 | Insulin receptor substrate 2 | 5'-GATCCCGCCTCAACAACAACAACAACT TCAAGAGAGTTGTTGTTGTTGTTGAGGTTT TTTGGAAA-3' | 280 |
| NM_000691.3 | Hs.531682 | ALDH3A1 | Aldehyde dehydrogenase 3 family, memberA1 | 5'-AAG AAG AGC UUC GAG ACU UUC-3' | 281 |
| NM_000689.3 | Hs.76392 | ALDH1A1 | Aldehyde dehydrogenase 1 family, member A1 | 5'-AAC TGG GAG AGT ACG GTT TCC-3' | 282 |
| NM_000604.2 | Hs.549034 | FGFR1 | Fibroblast growth factor receptor 1 (fms-related tyrosine kinase 2, Pfeiffer syndrome) | 5'-AAGTCGGACGCAACAGAGAAA-3' | 283 |

| Accession # | Unigene # | Gene Symbol | Name | Sequence | SEQ ID NO: |
|---|---|---|---|---|---|
| NM_006006.3 | Hs.171299 | ZBTB16 | Zinc finger and BTB domain containing 16 | 5'-GGCCAACCAGAUGCGGCUGUU-3' | 284 |
| NM_006006.3 | Hs.171299 | ZBTB16 | Zinc finger and BTB domain containing 16 | 5'-GAUGUUUGACAUCCUCUUCUU-3' | 285 |
| NM_004348.1 | Hs.122116 | RUNX2 | Runt-related transcription factor 2 | 5'-GGCUGCAAGCAGUAUUUACUU-3' | 286 |
| NM_004348.1 | Hs.122116 | RUNX2 | Runt-related transcription factor 2 | 5'-GGACAGAGUCAGAUUACAGUU-3' | 287 |
| NM_014382.2 | Hs.546361 | ATP2C1 | ATPase, Ca++ transporting, type 2C, member 1 | 5'-AGCCACTGTGGAAGAAGTATATT-3' | 288 |
| NM_002083.2 | Hs.2704 | GPX2 | Glutathione peroxidase 2 (gastrointestinal) | 5'-CCCUCUGGUUGGUGAUUCAdTdT-3' | 289 |
| NM_002083.2 | Hs.2704 | GPX2 | Glutathione peroxidase 2 (gastrointestinal) | 5'-GGAUGAUGGCACCUUCCUAdTdT-3' | 290 |
| NM_000942.4 | Hs.434937 | PPIB | Peptidylprolyl isomerase B (cyclophilin B) | 5'-AATTGGAGATGAAGATGTAGG-3' | 291 |
| NM_003153.3 | Hs.524518 | STAT6 | Signal transducer and activator of transcription 6, interleukin-4 induced | 5'-CAGUUCCGCCACUUGCCAAdTdT-3' | 292 |
| NM_003153.3 | Hs.524518 | STAT6 | Signal transducer and activator of transcription 6, interleukin-4 induced | 5'-AGCCUGGUGGACAUUUAUUdTdT-3' | 293 |
| NM_003153.3 | Hs.524518 | STAT6 | Signal transducer and activator of transcription 6, interleukin-4 induced | 5'-GAUGUGUGAAACUCUGAACdTdT-3' | 294 |
| NM_003153.3 | Hs.524518 | STAT6 | Signal transducer and activator of transcription 6, interleukin-4 induced | 5'-CAGAUGGGUAAGGAUGGCAdTdT-3' | 295 |
| NM_002945.2 | Hs.461925 | RPA1 | Replication protein A1, 70 kDa | 5'-AAGCACUAUCAUUGCGAAUCC-3' | 296 |
| NM_003169.2 | Hs.437056 | SUPT5H | Suppressor of Ty 5 homolog | 5'-AACTGGGCGAGTATTACATGA-3' | 297 |
| NM_003318.3 | Hs.169840 | TTK | TTK protein kinase | 5'-TGAACAAAGTGAGAGACAT-3' | 298 |
| NM_007194.3 | Hs.291363 | CHEK2 | CHK2 checkpoint homolog (S. pombe) | 5'-AATGTGTGAATGACAACTACT-3' | 299 |
| NM_002358.2 | Hs.533185 | MAD2L1 | MAD2 mitotic arrest deficient-like 1 (yeast) | 5'-AATACGGACTCACCTTGCTTG-3' | 300 |
| NM_001401.3 | Hs.126667 | EDG2 | Endothelial differentiation, lysophosphatidic acid G-protein-coupled receptor, 2 | 5'-r(CCGCCGCUUCCAUUUUUCCU)d(TT)-3' | 301 |
| NM_001401.3 | Hs.126667 | EDG2 | Endothelial differentiation, lysophosphatidic acid G-protein-coupled receptor, 2 | 5'-r(AGGAAAAAUGGAAGCGGCGGG)d(TT)-3') | 302 |
| NM_004448.2 | Hs.446352 | ERBB2 | V-erb-b2 erythroblastic leukemia viral oncogene homolog 2 | 5'-CCUGGAACUCACCUACCUGdTdT-3' | 303 |
| NM_004448.2 | Hs.446352 | ERBB2 | V-erb-b2 erythroblastic leukemia viral oncogene homolog 2 | 5'-CUACCUUUCUACGGACGUGdTdT-3' | 304 |
| NM_004448.2 | Hs.446352 | ERBB2 | V-crb-b2 crythroblastic leukemia viral oncogene homolog 2 | 5'-GAUCCGGAAGUACACGAUGdTdT-3' | 305 |
| NM_014812.1 | Hs.533635 | KAB | KARP-1-binding protein | 5'-GAAGGAAUCCUCCAAGUCA-3' | 306 |

-continued

| Accession # | Unigene # | Gene Symbol | Name | Sequence | SEQ ID NO: |
|---|---|---|---|---|---|
| NM_002737.2 | Hs.531704 | PRKCA | Protein kinase C, alpha | 5'-AAGCTCCATGTCACAGTACGA-3' | 307 |
| NM_212535.1 | Hs.460355 | PRKCB1 | Protein kinase C, beta 1 | 5'-AAGCGCTGCGTCATGAATGTT-3' | 308 |
| NM_138578.1 | Hs.516966 | BCL2L1 | BCL2-like 1 | 5'-CTG CCT AAG GCG GAT TTG AAT-3' | 309 |
| NM_138578.1 | Hs.516966 | BCL2L1 | BCL2-like 1 | 5'-GGC AGG CGA CGA GTT TGA ACT-3' | 310 |
| NM_138578.1 | Hs.516966 | BCL2L1 | BCL2-like 1 | 5'-GTG CGT GGA AAG CGT AGA CAA-3' | 311 |
| NM_004050.2 | Hs.410026 | BCL2L2 | BCL2-like 2 | 5'-GGC GGA GTT CAC AGC TCT ATA-3' | 312 |
| NM_004050.2 | Hs.410026 | BCL2L2 | BCL2-like 2 | 5'-GTG GGC ATA AGT GCT GAT CTA-3' | 313 |
| NM_004050.2 | Hs.410026 | BCL2L2 | BCL2-like 2 | 5'-CTC GGT CCT GCG ATT ATT AAT-3' | 314 |
| NM_003443.1 | Hs.433764 | ZBTB17 | Zinc finger and BTB domain containing 17 | 5'-AAGGCCGAGATCAGCAAAGTTCAAGAGACT TGCTGATCTCGGCCTTTTTTTT-3' | 315 |
| NM_003345.3 | Hs.302903 | UBE2I | Ubiquitin-conjugating enzyme E2I (UBC9 homolog, yeast) | 5'-GGC CAG CCA UCA CAA UCA ATT-3' | 316 |
| NM_003345.3 | Hs.302903 | UBE2I | Ubiquitin-conjugating enzyme E2I (UBC9 homolog, yeast) | 5'-GGA ACU UCU AAA UGA ACC ATT-3' | 317 |
| NM_016166.1 | Hs.162458 | PIAS1 | Protein inhibitor of activated STAT, 1 | 5'-GGU CCA GUU AAG GUU UUG UTT-3' | 318 |
| NM_016166.1 | Hs.162458 | PIAS1 | Protein inhibitor of activated STAT, 1 | 5'-GGU UAC CUU CCA CCU ACA ATT-3' | 319 |
| NM_004068.2 | Hs.518460 | AP2M1 | Adaptor-related protein complex 2, mu 1 subunit | 5'-AAGUGGAUGCCUUUCGGGUCA-3' | 320 |
| NM_004068.2 | Hs.518460 | AP2M1 | Adaptor-related protein complex 2, mu 1 subunit | 5'-AAGGAGAACAGUUCUUGCGGC-3' | 321 |
| NM_004068.2 | Hs.518460 | AP2M1 | Adaptor-related protein complex 2, mu 1 subunit | 5'-AAGGUCCAGU-CAUUCCAAAUG-3' | 322 |
| NM_001278.2 | Hs.198998 | CHUK | Conserved helix-loop-helix ubiquitous kinase | 5'-AGGAAGGACCUGUUGACCUUTT-3' | 323 |
| NM_001556.1 | Hs.413513 | IKBKB | Inhibitor of kappa light polypeptide gene enhancer in B-cells, kinase beta | 5'-UGGUGAGCUUAAUGAAUGATT-3' | 324 |
| NM_021975.2 | Hs.502875 | RELA | V-rel reticuloendotheliosis viral oncogene homolog A | 5'-AGAGGACAUUGAGGUGUAUTT-3' | 325 |
| NM_000963.1 | Hs.196384 | PTGS2 | Prostaglandin-endoperoxide synthase 2 | 5'-AACTGCTCAACACCGGAATTTTT-3' | 326 |
| NM_005427.1 | Hs.192132 | TP73 | Tumor protein p73 | 5'-CCAUCCUGUACAACUUCAUGU G-3' | 327 |
| NM_005157.2 | Hs.431048 | ABL1 | V-abl Abelson murine leukemia viral oncogene homolog 1 | 5'-CAAUAAGGAAGAAGCCCUUTT-3' | 328 |
| NM_005157.2 | Hs.431048 | ABL1 | V-abl Abelson murine leukemia viral oncogene homolog 1 | 5'-TTAUUCCUUCUUCGGGAAGUC-3' | 329 |
| NM_001168.1 | Hs.514527 | BIRC5 | Baculoviral IAP repeat-containing 5 (survivin) | 5'-GGCUGGCUUCAUCCACUGCTT-3' | 330 |
| NM_002940.1 | Hs.12013 | ABCE1 | ATP-binding cassette, sub-family E (OABP), member 1 | 5'-CGAAGATGTTGACCTGGTC-3' | 331 |
| NM_002940.1 | Hs.12013 | ABCE1 | ATP-binding cassette, sub-family E (OABP), member 1 | 5'-AGAGTTGTCCTGTAGTTCG-3' | 332 |
| NM_004208.2 | Hs.424932 | PDCD8 | Programmed cell death 8 (apoptosis-inducing factor) | 5'-GGAAAUAUGGGAAAGAUCCdTdT | 333 |

-continued

| Accession # | Unigene # | Gene Symbol | Name | Sequence | SEQ ID NO: |
|---|---|---|---|---|---|
| NM_000115.1 | Hs.82002 | EDNRB | Endothelin receptor type B | 5'-GGAGACUUUCAAAUACAUCUUtt-3' | 334 |
| NM_001712.2 | Hs.512682 | CEACAM1 | Carcinoembryonic antigen-related cell adhesion molecule 1 | 5'-AACCTTCTGGAACCCGCCCAC-3' | 335 |
| NM_001712.2 | Hs.512682 | CEACAM1 | Carcinoembryonic antigen-related cell adhesion molecule 1 | 5'-AATGTTGCAGAGGGGAAGGAG-3' | 336 |
| NM_033284.1 | Hs.436900 | TBL1Y | Transducin (beta)-like 1Y-linked | 5'-AAGAGAATGGAGCACATGAAA-3' | 337 |
| NM_033284.1 | Hs.436900 | TBL1Y | Transducin (beta)-like 1Y-linked | 5'-AAGATGAGCATAACCAGTGAC-3' | 338 |
| NM_024665.3 | Hs.438970 | TBL1XR1 | Transducin (beta)-like 1X-linked receptor 1 | 5'-AAGGCCCTATATTTGCATTAA-3' | 339 |
| NM_173174.1 | Hs.491322 | PTK2B | PTK2B protein tyrosine kinase 2 beta | 5'-GTTGGCTGAGTGCTATGGGCTGA-3' | 340 |
| NM_006311.2 | Hs.462323 | NCOR1 | Nuclear receptor co-repressor 1 | 5'-GGGCTTATGGAGGACCCTATGA-3' | 341 |
| NM_002211.2 | Hs.429052 | ITGB1 | Integrin, beta 1 | 5'-GGAACAGCAGAGAAGCTCATTCAAGAGATGAGCTTCTCTGCTGTTCCTTTTT-3' | 342 |
| NM_139176.2 | Hs.351118 | NALP7 | NACHT, leucine rich repeat and PYD containing 7 | 5'-CACCGAAGCAGCACGACTTCTTCTTCAAGAGAAGAAGTCGTGCTGCTTC-3' | 343 |
| NM_004422.2 | Hs.118640 | DVL2 | Dishevelled, dsh homolog 2 (Drosophila) | 5'-AGGUUCAGCAGCUCCACGGAdTdT-3' | 344 |
| NM_001228.2 | Hs.369736 | CASP8 | Caspase 8, apoptosis-related cysteine protease | 5'-gatccccCCTCGGGGATACTGTCTGAttcaagagaTCAGACAGTATCCCCGAGGttttggaaa-3' | 345 |
| NM_001769.2 | Hs.114286 | CD9 | CD9 antigen (p24) | 5'-GAGCATCTTCGAGCAAGAA-3' | 346 |
| NM_004357.3 | Hs.512857 | CD151 | CD151 antigen | 5'-CATGTGGCACCGTTTGCCT-3' | 347 |
| NM_003188.2 | Hs.485968 | MAP3K7 | Mitogen-activated protein kinase kinase kinase 7 | 5'-UGGCUUAUCUUACACUGGA-3' | 348 |
| NM_006116.2 | Hs.507681 | MAP3K7IP1 | Mitogen-activated protein kinase kinase kinase 7 interacting protein 1 | 5'-GGCUCAAGUUCAGGAGUGAGAACAA-3' | 349 |
| NM_015093.2 | Hs.269775 | MAP3K7IP2 | Mitogen-activated protein kinase kinase kinase 7 interacting protein 2 | 5'-GGAACGACUUCAAAGAGAACUUGAG-3' | 350 |
| NM_001315.1 | Hs.485233 | MAPK14 | Mitogen-activated protein kinase 14 | 5'-GCAUUACAACCAGACAGUUGAUAUU-3' | 351 |
| NM_006502.1 | Hs.439153 | POLH | Polymerase (DNA directed), eta | 5'-GUG GAG CAG CGG CAA AAU CTT-3' | 352 |
| NM_006502.1 | Hs.439153 | POLH | Polymerase (DNA directed), eta | 5'-UCC UCA UUU GAG GAA UAA ATT-3' | 353 |
| NM_006502.1 | Hs.439153 | POLH | Polymerase (DNA directed), eta | 5'-GGA AUA AAC CUU GUG CAG UTT-3' | 354 |
| NM_006502.1 | Hs.439153 | POLH | Polymerase (DNA directed), eta | 5'-UAA ACC UUG UGC AGU UGU ATT-3' | 355 |
| NM_006502.1 | Hs.439153 | POLH | Polymerase (DNA directed), eta | 5'-CCU UGU GCA GUU GUA CAG UTT-3' | 356 |
| NM_015321.1 | Hs.371096 | MECT1 | Mucoepidermoid carcinoma translocated 1 | 5'-CCGGCAACCUCGCGGCCAAUU-3' | 357 |
| NM_181715.1 | Hs.406392 | TORC2 | Transducer of regulated cAMP response element-binding protein (CREB) 2 | 5'-CGACUACCAUCUGCACUUAUU-3' | 358 |

| Accession # | Unigene # | Gene Symbol | Name | Sequence | SEQ ID NO: |
|---|---|---|---|---|---|
| NM_001079.3 | Hs.234569 | ZAP70 | Zeta-chain (TCR) associated protein kinase 70 kDa | 5'-AACCGGCTCTCCATTGGCATT-3' | 359 |
| NM_004834.3 | Hs.431550 | MAP4K4 | Mitogen-activated protein kinase kinase kinase kinase 4 | 5'-GTGGTTGGAAATGGCACCTTT-3' | 360 |
| NM_006191.1 | Hs.524498 | PA2G4 | Proliferation-associated 2G4, 38 kDa | 5'-AAGCGACCAGGAUUAUAUUCU-3' | 361 |
| NM_006191.1 | Hs.524498 | PA2G4 | Proliferation-associated 2G4, 38 kDa | 5'-AAGUGAGGUGGAAAGGCGUUU-3' | 362 |
| NM_005940.3 | Hs.143751 | MMP11 | Matrix metalloproteinase 11 (stromelysin 3) | 5'-TCCCATGTCCACTTCGACTATGATGTCAAGAGCATCATAGTCGAAGTGGACATTT-3' | 363 |
| NM_005940.3 | Hs.143751 | MMP11 | Matrix metalloproteinase 11 (stromelysin 3) | 5'-TCCCAGATCTACTTCTTCCGAGGTCAAGAGCCTCGGAAGAAGTAGATCTTT-3' | 364 |
| NM_005940.3 | Hs.143751 | MMP11 | Matrix metalloproteinase 11 (stromelysin 3) | 5'-TCCCAGGATGCTGATGGCTATGCCTTCAAGAGAGGCATAGCCATCAGCATCCTTT-3' | 365 |
| NM_003684.3 | Hs.371594 | MKNK1 | MAP kinase interacting serine/threonine kinase 1 | 5'-AATGCCCATCTCTATAGGTTT-3' | 366 |
| NM_003668.2 | Hs.413901 | MAPKAPK5 | Mitogen-activated protein kinase-activated protein kinase 5 | 5'-GGAUAUGCGAAGAAAGAUCTT-3' | 367 |
| NM_004604.3 | Hs.83734 | STX4A | Syntaxin 4A (placental) | 5'-AAGGAGGAAGCTGATGAGAAC-3' | 368 |
| NM_004177.3 | Hs.530733 | STX3A | Syntaxin 3A | 5'-AACGTCCGGAACAAACTGAAG-3' | 369 |
| NM_001009567.1 | Hs.461247 | MRC1L1 | Mannose receptor, C type 1-like 1 | 5'-AAGTGGTACGCAGATTGCACG-3' | 370 |
| NM_002576.3 | Hs.435714 | PAK1 | P21/Cdc42/Rac1-activated kinase 1 | 5'-AAGGAGAAGAAAAGAAGGAC-3' | 371 |
| NM_001664.2 | Hs.247077 | RHOA | Ras homolog gene family, member A | 5'-GCAGGTAGAGTTGGCTTTG-3' | 372 |
| NM_175744.3 | Hs.502659 | RHOC | Ras homolog gene family, member C | 5'-GACTATGATCGACTGCGGC-3' | 373 |
| NM_080491.1 | Hs.429434 | GAB2 | GRB2-associated binding protein 2 | 5'-GTGAGAACGATGAGAAATA-3' | 374 |
| NM_080491.1 | Hs.429434 | GAB2 | GRB2-associated binding protein 2 | 5'-GTTGGTGCCTAATCACTTA-3' | 375 |
| NM_005225.1 | Hs.96055 | E2F1 | E2F transcription factor 1 | 5'-GACGTGTCAGGACCTTCGT-3' | 376 |
| NM_005225.1 | Hs.96055 | E2F1 | E2F transcription factor 1 | 5'-CTTAACTGGTGTACATTAA-3' | 377 |
| NM_006392.2 | Hs.376064 | NOL5A | Nucleolar protein 5A (56 kDa with KKE/D repeat) | 5'-CAAUAUGAUCAUCCAGUCCAUUA-3' | 378 |
| NM_015934 | Hs.471104 | NOP5/NOP58 | Nucleolar protein NOP5/NOP58 | 5'-CAAGCAUGCAGCUUCUACCGUUC-3' | 379 |
| NM_001436 | Hs.299002 | FBL | Fibrillarin | 5'-CAGUCGAGUUCUCCCACCGCUCU-3' | 380 |
| NM_006666 | Hs.515846 | RUVBL2 | RuvB-like 2 (E. coli) | 5'-GAGACCAUCUACGACCUGGGCAC-3' | 381 |
| NM_006666 | Hs.515846 | RUVBL2 | RuvB-like 2 (E. coli) | 5'-GAGAGUGACAUGGCGCCUGUCCU-3' | 382 |
| NM_003707.1 | Hs.272822 | RUVBL1 | RuvB-like 1 (E. coli) | 5'-AAGGAACCAAACAGUUGAAACUG-3' | 383 |
| NM_003707.1 | Hs.272822 | RUVBL1 | RuvB-like 1 (E. coli) | 5'-GAGUCUUCUAUCGCUCCCAUCGU-3' | 384 |
| NM_004741 | Hs.523238 | NOLC1 | Nucleolar and coiled-body phosphoprotein 1 | 5'-AAAUUGAGGUGGAUUCACGAGUU-3' | 385 |

| Accession # | Unigene # | Gene Symbol | Name | Sequence | SEQ ID NO: |
|---|---|---|---|---|---|
| NM_032177 | Hs.546453 | PHAX | RNA U, small nuclear RNA export adaptor (phosphorylation regulated) | 5'-UAGUAUCAGCGAGGAACAAAUUA-3' | 386 |
| NM_032177 | Hs.546453 | PHAX | RNA U, small nuclear RNA export adaptor (phosphorylation regulated) | 5'-AAGAGUAUAUAGCACAGGAUUUA-3' | 387 |
| NM_024831 | Hs.335068 | NCOA6IP | Nuclear receptor coactivator 6 interacting protein | 5'-AAGAUUGCCCUUGCUCGCAAUAA-3' | 388 |
| NM_024831 | Hs.335068 | NCOA6IP | Nuclear receptor coactivator 6 interacting protein | 5'-UAUCACCGUAUGAAAUGGAAACU-3' | 389 |
| NM_022874.1 | Hs.202179 | SMN2 | Survival of motor neuron 1, telomeric | 5'-AAGUGGAAUGGGUAACUCUUCUU-3' | 390 |
| NM_012321.2 | Hs.515255 | LSM4 | LSM4 homolog, U6 small nuclear RNA associated | 5'-AACGGCCGUCCCAAAGCUGGCUG-3' | 391 |
| NM_016200.2 | Hs.446179 | LSM8 | LSM8 homolog, U6 small nuclear RNA associated | 5'-AAGAAACAGAUUCUGCGCUUGAU-3' | 392 |
| NM_003142 | Hs.546301 | SSB | Sjogren syndrome antigen B (autoantigen La) | 5'-GAAUUAGGUCCACUUCAAUGUCC-3' | 393 |
| NM_003142 | Hs.546301 | SSB | Sjogren syndrome antigen B autoantigen La) | 5'-AAGAUUCUUCCAUUAAAUUGCCU-3' | 394 |
| NM_001228 | Hs.369736 | CASP8 | Caspase 8, apoptosis-related cysteine protease | 5'-AACTACCAGAAAGGTATACCT-3' | 395 |
| NM_003842.3 | Hs.521456 | TNFRSF10B | Tumor necrosis factor receptor superfamily, member 10b | 5'-AAGACCCTTGTGCTCGTTGTC-3' | 396 |
| NM_017672.2 | Hs.512894 | TRPM7 | Transient receptor potential cation channel, subfamily M, member 7 | 5'-AAGCAGAGTGACCTGGTAGAT-3' | 397 |
| NM_007294.1 | Hs.194143 | BRCA1 | Breast cancer 1, early onset | 5'-UCACAGUGUCCUUUAUGUAdTdT-3' | 398 |
| NM_033238.1 | Hs.526464 | PML | Promyelocytic leukemia | 5'-AUGGCUUCGACGAGUUCAAUU-3' | 399 |
| NM_000546.2 | Hs.408312 | TP53 | Tumor protein p53 (Li-Fraumeni syndrome) | 5'-GCAUGAACCGGAGGCCCAUTT-3' | 400 |
| NM_002198.1 | Hs.436061 | IRF1 | Interferon regulatory factor 1 | 5'-AGACCAGAGCAGGAACAAGTT-3' | 401 |
| NM_024790.3 | Hs.370147 | FLJ22490 | Hypothetical protein FLJ22490 | 5'-GAAGATTTGCGCAGTGGAC-3' | 402 |
| NM_000546.2 | Hs.408312 | TP53 | Tumor protein p53 (Li-Fraumeni syndrome) | 5'-UGGUUCACUGAAGACCCAGUU-3' | 403 |
| NM_002880.2 | Hs.159130 | RAF1 | V-raf-1 murine leukemia viral oncogene homolog 1 | 5'-AUUCCUGCUCAAUGGAUUUdTdT-3' | 404 |
| NM_198400.1 | Hs.1565 | NEDD4 | Neural precursor cell expressed, developmentally down-regulated 4 | 5'-TAGAGCCTGGCTGGGTTGTTTG-3' | 405 |
| NM_015277.2 | Hs.185677 | NEDD4L | Neural precursor cell expressed, developmentally down-regulated 4-like | 5'-AACCACAACACAAAGTCACAG-3' | 406 |
| NM_016931.2 | Hs.371036 | NOX4 | NADPH oxidase 4 | 5'-AAACCGGCAGGAGUUUACCCAG-3' | 407 |
| NM_005975.2 | Hs.51133 | PTK6 | PTK6 protein tyrosine kinase 6 | 5'-AAGGUGGCCAUUAAGGUGAUU-3' | 408 |
| NM_005531.1 | Hs.380250 | IFI16 | Interferon, gamma-inducible protein 16 | 5'-UCAGAAGACCACAAUCUAC-3' | 409 |
| NM_000633.1 | Hs.150749 | BCL2 | B-cell CLL/lymphoma 2 | 5'-GUGAAGUCAACAUGCCUGC-dTdT-3' | 410 |

-continued

| Accession # | Unigene # | Gene Symbol | Name | Sequence | SEQ ID NO: |
|---|---|---|---|---|---|
| NM_182981.1 | Es.528383 | OKL38 | Pregnancy-induced growth inhibitor | 5'-CACCCUACACGAAGCCAGATT-3' | 411 |
| NM_002961.2 | Hs.81256 | S100A4 | S100 calcium binding protein A4 | 5'-GGA CAG AUG AAG CUG CUU UTT-3' | 412 |
| NM_014585.3 | Hs.529285 | SLC40A1 | Solute carrier family 40 (iron-regulated transporter), member 1 | 5'-GGTGGACAAGAATGCTAGAC-3' | 413 |
| NM_014585.3 | Hs.529285 | SLC40A1 | Solute carrier family 40 (iron-regulated transporter), member 1 | 5'-GAAGGATTGACCAGTTAACC-3' | 414 |
| NM_014585.3 | Hs.529285 | SLC40A1 | Solute carrier family 40 (iron-regulated transporter), member 1 | 5'-GCTTGAACATGAGCAAGAGC-3' | 415 |
| NM_021127.1 | Hs.96 | PMAIP1 | Phorbol-12-myristate-13-acetate-induced protein 1 | 5'-AACTTCCGGCAGAAACTTCTG-3' | 416 |
| NM_002467.2 | Hs.202453 | MYC | V-myc myelocytomatosis viral oncogene nomolog (avian) | 5'-GCCACAGCAUACAUCCUGUdTdT-3' | 417 |
| NM_002187.2 | Hs.674 | IL12B | Interleukin 12B | 5'-CGCACGCUAAUGCUGGCAUdTdT-3' | 418 |
| NM_019887.3 | Hs.169611 | DIABLO | Diablo homolog (*Drosophila*) | 5'-AAGCGGUGUUUCUCAGAATTGtt-3' | 419 |
| NM_017563 | Hs.150725 | IL17RD | Interleukin 17 receptor D | 5'-GUCGG AGGGA AGACA GUGCT T-3' | 420 |
| NM_017563 | Hs.150725 | IL17RD | ilnterleukin 17 receptor D | 5'-GCAUG UGAUU GCUGA CGCCT T-3' | 421 |
| NM_003142.2 | Hs.546301 | SSB | Sjogren syndrome antigen B (autoantigen La) | 5'-AAGGCTTCCC AACTGATGC AA-3' | 422 |
| NM_003142.2 | Hs.546301 | SSB | Sjogren syndrome antigen B (autoantigen La) | 5'-AAGCCAAG GAAGCAT TGGGTA-3' | 423 |
| NM_003142.2 | Hs.546301 | SSB | Sjogren syndrome antigen B (autoantigen La) | 5'-AAGTACTAGAA GGAGAGGTGG-3' | 424 |
| NM_006101 | Hs.414407 | KNTC2 | Kinetochore associated 2 | 5'-GTTCAAAAGCTGGATGATCTT-3' | 425 |
| NM_145697 | Hs.234545 | CDCA1 | Cell division cycle associated 1 | 5'-AAGATACGGTCCAGAAGCTTA-3' | 426 |
| NM_003550 | Hs.209128 | MAD1L1 | MAD1 mitotic arrest deficient-like 1 | 5'-CCAGCGGCTCAAGGAGGTTTT-3' | 427 |
| NM_002358 | Hs.533185 | MAD2L1 | MAD2 mitotic arrest deficient-like 1 | 5'-GAGTCGGGACCACAGTTTATT-3' | 428 |
| NM_004336 | Hs.469649 | BUB1 | BUB1 budding uninhibited by benzimidazoles 1 homolog | 5'-TAGGCTAATTGTACTGCTCTT-3' | 429 |
| NM_001211.4 | Hs.36708 | BUB1B | BUB1 budding uninhibited by benzimidazoles 1 homolog beta | 5'-GGAGATCCTCTACAAAGGGTT-3' | 430 |
| NM_016343.3 | Hs.497741 | CENPF | Centromere protein F, 350/400 ka (mitosin) | 5'-AAGAGATGCTAATAGCAGTTT-3' | 431 |
| NM_001813 | Hs.75573 | CENPE | Centromere protein E, 312 kDa | 5'-ACTCTTACTGCTCTCCAGTTT-3' | 432 |
| NM_004217 | Hs.442658 | AURKB | Aurora kinase B | 5'-CGAGACCTATCGCCGCATCGT-3' | 433 |
| NM_005030 | Hs.329989 | PLK1 | Polo-like kinase 1 | 5'-GGGCGGCTTTGCCAAGTGCTT-3' | 434 |
| NM_004104 | Hs.83190 | FASN | Fatty acid synthase | 5'-CCCUGAGAUCCCAGCGCUGdTdT-3' | 435 |
| NM_021975.2 | Hs.502875 | RELA | V-rel reticuloendotheliosis viral oncogene homolog A | 5'-GATCAATGGCTACACAGGA-3' | 436 |
| NM_033256 | Hs.348037 | PPP1R14A | Protein phosphatase 1, regulatory (inhibitor) subunit 14A | 5'-ACCUGUCGAGGACUUCAUCdTdT-3' | 437 |

-continued

| Accession # | Unigene # | Gene Symbol | Name | Sequence | SEQ ID NO: |
|---|---|---|---|---|---|
| NM_177966.3 | Hs.151293 | 2'-PDE | 2'-phosphodiesterase | 5'-GUACAAGGUGGAGCGCAACdTdT-3' | 438 |
| NM_015355 | Hs.462732 | SUZ12 | Suppressor of zeste 12 homolog | 5'-CCCGGAAATTTCCCGTCCC-3' | 439 |
| NM_015355 | Hs.462732 | SUZ12 | Suppressor of zeste 12 homolog | 5'-GAGATGACCTGCATTGCCC-3' | 440 |
| NM_016179.1 | Hs.262960 | TRPC4 | Transient receptor potential cation channel, subfamily C, member 4 | 5'-ACUCUUGGUUCAGAAAGGATT-3' | 441 |
| NM_000249 | Hs.195364 | MLH1 | MutL homolog 1, colon cancer, nonpolyposis type 2 | 5'-GGTTCACTACTAGTAAACT-3' | 442 |
| NM_000534 | Hs.111749 | PMS1 | PMS1 postmeiotic segregation increased 1 | 5'-GGAATCTACTCGTTTGTAT-3' | 443 |
| NM_002198 | Hs.436061 | IRF1 | Interferon regulatory factor 1 | 5'-CCAAGAACCAGAGAAAAGATT-3' | 444 |
| NM_002199.2 | Hs.374097 | IRF2 | Interferon regulatory factor 2 | 5'-CUCUUUAGAAACUGGGCAATT-3' | 445 |
| NM_000546.2 | Hs.408312 | TP53 | Tumor protein p53 (Li-Fraumeni syndrome) | 5'-AAGACTCCAGTGGTAATCTAC-3' | 446 |
| NM_000051 | Hs.435561 | ATM | Ataxia telangiectasia mutated (includes complementation groups A, C and D) | 5'-TAGAGCTACAGAACGAAAG-3' | 447 |
| NM_000051 | Hs.435561 | ATM | Ataxia telangiectasia mutated (includes complementation groups A, C and D) | 5'-GAATGTGAACACCACCAAA-3' | 448 |
| NM_000051 | Hs.435561 | ATM | Ataxia telangiectasia mutated (includes complementation groups A, C and D) | 5'-CTACACAAATATTGAGGAT-3' | 449 |
| NM_000051 | Hs.435561 | ATM | Ataxia telangiectasia mutated (includes complementation groups A, C and D) | 5'-CTGTACTTCCATACTTGAT-3' | 450 |
| NM_001184 | Hs.271791 | ATR | Ataxia telangiectasia and Rad3 related | 5'-AAGCCAAGACAAATTCTGTGT-3' | 451 |
| NM_001184 | Hs.271791 | ATR | Ataxia telangiectasia and Rad3 related | 5'-AACCTCCGTGATGTTGCTTGA-3' | 452 |
| NM_001798.2 | Hs.19192 | CDK2 | Cyclin-dependent kinase 2 | 5'-CAAAGCCAGAAACAAGTTG-3' | 453 |
| NM_001798.2 | Hs.19192 | CDK2 | Cyclin-dependent kinase 2 | 5'-AAATAAACTCTACCTGGTT-3' | 454 |
| NM_001798.2 | Hs.19192 | CDK2 | Cyclin-dependent kinase 2 | 5'-AAACCTCAGAATCTGCTTA-3' | 455 |
| NM_001798.2 | Hs.19192 | CDK2 | Cyclin-dependent kinase 2 | 5'-GTTACTTCTATGCCTGATT-3 | 456 |
| NM_207003 | Hs.469658 | BCL2L11 | BCL2-like 11 (apoptosis facilitator) | 5'-(GACCGAGAAGGUAGACAAUUG)d(TT)-3' | 457 |
| NM_000166 | Hs.333303 | GJB1 | Gap junction protein, beta 1, 32 kDa | 5'-AAGAGGCACAAGGTCCACATCdTdT-3' | 458 |
| NM_000359 | Hs.508950 | TGM1 | Transglutaminase 1 | 5'-AUGCAGCUGGAGAUGGCACdTdT-3' | 459 |
| NM_024596 | Hs.550532 | MCPH1 | Microcephaly, primary autosomal recessive 1 | 5'-AGGAAGUUGGAAGGAUCCAdTdT-3' | 460 |
| NM_024596 | Hs.550532 | MCPH1 | Microcephaly, primary autosomal recessive 1 | 5'-GAACACUUAUCAAGCCUAAUU-3' | 461 |
| NM_024596 | Hs.550532 | MCPH1 | Microcephaly, primary autosomal recessive 1 | 5'-GGAGAGAACAAGCAUAUUUUU-3' | 462 |
| NM_024596 | Hs.550532 | MCPH1 | Microcephaly, primary autosomal recessive 1 | 5'-UGAUGUACCUAUUCUCUUAUU-3' | 463 |

-continued

| Accession # | Unigene # | Gene Symbol | Name | Sequence | SEQ ID NO: |
|---|---|---|---|---|---|
| NM_024596 | Hs.550532 | MCPH1 | Microcephaly, primary autosomal recessive 1 | 5'-GAUAAGAGAUUUCAGAAGAUU-3' | 464 |
| NM_024596 | Hs.550532 | MCPH1 | Microcephaly, primary autosomal recessive 1 | 5'-GUCACCACAGCGCAATGGAdTdT-3' | 465 |
| NM_000245 | Hs.132966 | MET | Met proto-oncogene (hepatocyte growth factor receptor) | 5'-ACUCUAGAUGCUCAGACUUTT-3' | 466 |
| NM_205860.1 | Hs.33446 | NR5A2 | Nuclear receptor subfamily 5, group A, member 2 | 5'-AGGATCCATCTTCCTGGTTAC-3' | 467 |
| NM_182763.1 | Hs.532826 | MCL1 | Myeloid cell leukemia Sequence 1 (BCL2-related) | 5'-UAACACCAGUACGGACGGGdTdT-3' | 468 |
| NM_008765 | Hs.444870 | ORC2L | Origin recognition complex, Subunit 2-like | 5'-UGCUCCUCUCAUGUGGGAU-3' | 469 |
| NM_006190 | Hs.444870 | ORC2L | Origin recognition complex, Subunit 2-like | 5'-UCAUUGGUCAGUUGUCAUC-3' | 470 |
| NM_181837 | Hs.410228 | ORC3L | Origin recognition complex, Subunit 3-like | 5'-GAGACUUGGGCGGUCAAAU-3' | 471 |
| NM_002592.2 | Hs.147433 | PCNA | Proliferating cell nuclear antigen | 5'-CGGUGACACUCAGUAUGUC-3' | 472 |
| NM_016526 | Hs.414418 | BET1L | Blocked early in transport 1 homolog (*S. cerevisiae*) like | 5'-AAGCAUGACCAGCCUGCUUAC-3' | 473 |
| NM_001569 | Hs.522819 | IRAK1 | Interleukin-1 receptor-associated kinase 1 | 5'-GGUUGUCCUUGAGUAAUAAtt-3' | 474 |
| NM_080649 | Hs.73722 | APEX1 | APEX nuclease (multifunctional DNA repair enzyme) 1 | 5'-GUCUGGUACGACUGGAGUACC-3' | 475 |
| NM_002658 | Hs.77274 | PLAU | plasminogen activator, urokinase | 5'-AACATTCACTGGTGCAACTGC-3' | 476 |
| NM_001654 | Hs.446641 | ARAF | V-raf murine sarcoma 3611 viral oncogene homolog | 5'-AACAACATCTTCCTACATGAG-3' | 477 |
| NM_004333 | Hs.490366 | BRAF | V-raf murine sarcoma viral oncogene homolog B1 | 5'-AAAGAATTGGATCTGGATCAT-3' | 478 |
| NM_002880 | Hs.159130 | RAF1 | V-raf-1 murine leukemia viral oncogene homolog 1 | 5'-AAUAGUUCAGCAGUUUGGCUA-3' | 479 |
| NM_014314 | Hs.190622 | DDX58 | DEAD (Asp-Glu-Ala-Asp) box polypeptide 58 | 5'-GAATTTAAAACCAGAATTATC-3' | 480 |
| NM_000927.3 | Hs.489033 | ABCB1 | ATP-binding cassette, sub-family B (MDR/TAP), member 1 | 5'-AAGCGAAGCAGTGGTTCAGGT-3' | 481 |
| NM_001753.3 | Hs.74034 | CAV1 | Caveolin 1, caveolae protein, 22 kDa | 5'-AGACGAGCUGAGCGAGAAGCA-3' | 482 |
| NM_001753.3 | Hs.74034 | CAV1 | Caveolin 1, caveolae protein, 22 kDa | 5'-CAUCUACAAGCCCAACAACUU-3' | 483 |
| NM_000389.2 | Hs.370771 | CDKN1A | Cyclin-dependent kinase inhibitor 1A (p21, Cip1) | 5'-CUUCGACUUUGUCACCGAG-3' | 484 |
| NM_007294.1 | Hs.194143 | BRCA1 | Breast cancer 1, early onset | 5'-AACCTGTCTCCACAAAGTGTG-3' | 485 |
| NM_002105 | Hs.477879 | H2AFX | H2A histone family, member X | 5'-CAA CAA GAA GAC GCG AAU CdTdT-3' | 486 |
| NM_020382 | Hs.443735 | SET8 | PR/SET domain containing protein 8 | 5'-AAUCGCCUAGGAAGACUGAUC-3' | 487 |

-continued

| Accession # | Unigene # | Gene Symbol | Name | Sequence | SEQ ID NO: |
|---|---|---|---|---|---|
| NM_012331 | Hs.490981 | MSRA | Methionine sulfoxide reductase A | 5'-CCCCUGUAGCGGCCAAACAUU-3' | 488 |
| NM_012331 | Hs.490981 | MSRA | Methionine sulfoxide reductase A | 5'-CAAAGUACAAAGGAAUUUAUU-3' | 489 |
| NM_012331 | Hs.490981 | MSRA | Methionine sulfoxide reductase A | 5'-CGGGAGGGACAGACUUUCUUU-3' | 490 |
| NM_014554 | Hs.371957 | SENP1 | SUMO1/sentrin specific protease 1 | 5'-GTGAACCACAACTCCGTATTC-3' | 491 |
| NM_002945 | Hs.461925 | RPA1 | Replication protein A1, 70 kDa | 5'-AACUGGUUGACGAAAGUGGUG-3' | 492 |
| NM_001184 | Hs.271791 | ATR | Ataxia telangiectasia and Rad3 related | 5'-AACCCGCGUUGGCGUGGUUGA-3' | 493 |
| NM_001430.3 | Hs.468410 | EPAS1 | Endothelial PAS domain protein 1 | 5'-ACCAAUCCAGCACCCAUCCdTdT-3' | 494 |
| NM_001530.2 | Hs.509554 | HIF1A | Hypoxia-inducible factor 1, alpha subunit (basic helix-loop-helix transcription factor) | 5'-CUGAUGACCAGCAACUUGAdTdT-3' | 495 |
| NM_021972 | Hs.68061 | SPHK1 | Sphingosine kinase 1 | 5'-GAGCUGCAAGGCCUUGCCCdTdT-3 | 496 |
| NM_002502 | Hs.73090 | NFKB2 | Nuclear factor of kappa light polypeptide gene enhancer in B-cells 2 (p49/p100) | 5'-CTCCTCCATTGTGGAACCCAAGGAGC-3' | 497 |
| NM_016829 | Hs.380271 | OGG1 | 8-oxoguanine DNA glycosylase | 5'-GUAUGGACACUGACUCAGAUU-3' | 498 |
| NM_016829 | Hs.380271 | OGG1 | 8-oxoguanine DNA glycosylase | 5'-GUACUUCCAGCUAGAUGUUUU-3' | 499 |
| NM_006142 | Hs.523718 | SFN | Stratifin | 5'-GAGCGAAACCUGCUCUCAG-3' | 500 |
| NM_006142 | Hs.523718 | SFN | Stratifin | 5'-GGGUGACUACUACCGCUAC-3' | 501 |
| NM_006142 | Hs.523718 | SFN | Stratifin | 5'-AGACAGCACCCUCAUCAUG-3' | 502 |
| NM_00615 | Hs.477693 | NCK1 | NCK adaptor protein 1 | 5'-GUCCUGGUGGCGAGUUCGAUU-3' | 503 |
| NM_00615 | Hs.477693 | NCK1 | NCK adaptor protein 1 | 5'-CGUCUCUAUGACCUCAACAUU-3' | 504 |
| NM_002422 | Hs.375129 | MMP3 | Matrix metalloproteinase 3 stromelysin 1, progelatinase) | 5'-AUGAAGAGUCUUCCAAUCCUU-3' | 505 |
| NM_000021.2 | Hs.3260 | PSEN1 | Presenilin 1 (Alzheimer disease 3) | 5'-AAGGTCCACTTCGTATGCTGG-3' | 506 |
| NM_015331 | Hs.517249 | NCSTN | Nicastrin | 5'-AAGGGCAAGTTTCCCGTGCAG-3' | 507 |
| NM_016022 | Hs.108408 | APH-1A | Anterior pharynx defective 1 homolog A (C. elegans) | 5'-AAGAAGGCAGATGAGGGGTTA-3' | 508 |
| NM_172341 | Hs.534465 | PEN2 | Presenilin enhancer 2 homolog (C. elegans) | 5'-AAUCAAAGGCUAUGUCUGGCG-3' | 509 |
| NM_020673 | Hs.529044 | RAB22A | RAB22, member RAS oncogene family | 5'-AAGGACUACGCCGACUCUAUU-3' | 510 |
| NM_001002814 | Hs.191179 | RAB11FIP1 | RAB11 family interacting protein 1 (class I) | 5'-CGCCTCTTTCCCAGTCCATGT-3' | 511 |
| NM_015470 | Hs.24557 | RAB11FIP5 | RAB11 family interacting protein 5 (class I) | 5'-GAGCTGAGTGCTCAGGCTAAA-3' | 512 |
| NM_030791 | Hs.24678 | SGPP1 | Sphingosine-1-phosphate phosphatase 1 | 5'-AGUGGCCCGUUUCCAGCGGdTT-3' | 513 |
| NM_005406 | Hs.306307 | ROCK1 | Rho-associated, coiled-coil containing protein kinase 1 | 5'-AAGGTGATTGGTAGAGGTGCA-3' | 514 |

-continued

| Accession # | Unigene # | Gene Symbol | Name | Sequence | SEQ ID NO: |
|---|---|---|---|---|---|
| NM_198437 | Hs.250822 | STK6 | Serine/threonine kinase 6 | 5'-AAGCACAAAAGCTTGTCTCCA-3' | 515 |
| NM_006272 | Hs.422181 | S100B | S100 calcium binding protein, beta (neural) | 5'-GGAAUUCAUGGCCUUUGUU-3' | 516 |
| NM_004219 | Hs.350966 | PTTG1 | Pituitary tumor-transforming 1 | 5'-GAU CUC AAG UUU CAA CAC Ctt-3' | 517 |
| NM_004219 | Hs.350966 | PTTG1 | Pituitary tumor-transforming 1 | 5'-GUC UGU AA A GAC CAA GG GAtt-3' | 518 |
| NM_001478.2 | Hs.159481 | GALGT | UDP-N-acetyl-alpha-D-galactosamine:(N-acetylneuraminyl)-galactosylglucosylceramide N-acetylgalactosaminyltransferase | 5'-GGAGCAAGUAGUGGGGCUGdTdT-3' | 519 |
| NM_000657 | Hs.150749 | BCL2 | B-cell CLL/lymphoma 2 | 5'-GUACAUCCAUUAUAAGCUGTT-3' | 520 |
| NM_032984 | Hs.368982 | CASP2 | Caspase 2, apoptosis-related cysteine protease | 5'-AACUUCCAGCUGGCAUAUAGGdTdT-3' | 521 |
| NM_001228 | Hs.369736 | CASP8 | Caspase 8, apoptosis-related cysteine protease | 5'-AAGGGUCAUGCUCUAUCAGAUdTdT-3' | 522 |
| NM_197967 | Hs.474150 | BID | BH3 interacting domain death agonist | 5'-AAGAAGACAUCAUCCGGAAUAdTdT-3' | 523 |
| NM_001167 | Hs.356076 | BIRC4 | Baculoviral IAP repeat-containing 4 | 5'-AAGGAGAUACCGUGCGGUGCUdTdT-3' | 524 |
| NM_002483 | Hs.466814 | CEACAM6 | Carcinoembryonic antigen-related cell adhesion molecule 6 | 5'-CCGGACAGTTCCATGTATA-3' | 525 |
| NM_001008490 | Hs.285313 | KLF6 | Kruppel-like factor 6 | 5'-GGAGAAAAGCCUUACAGAUTT-3' | 526 |
| NM_024309 | Hs.368551 | TNIP2 | TNFAIP3 interacting protein 2 | 5'-GUAUUUGGCCGCCGACGCAd(TT)-3' | 527 |
| NM_001621 | Hs.171189 | AHR | Aryl hydrocarbon receptor | 5'-AAGACTGGAGAAAGTGGCATG-3' | 528 |
| NM_001005845 | Hs.2442 | ADAM9 | A disintegrin and metalloproteinase domain 9 (meltrin gamma) | 5'-AAUCACUGUGGAGACAUUUGCdTdT-3' | 529 |
| NM_001110 | Hs.172028 | ADAM10 | A disintegrin and metalloproteinase domain 10 | 5'-AAUGAAGAGGGACACUUCCCUdTdT-3' | 530 |
| NM_021641 | Hs.386283 | ADAM12 | A disintegrin and metalloproteinase domain 12 | 5'-AACCUCGCUGCAAAGAAUGUGdTdT-3' | 531 |
| NM_207196 | Hs.312098 | ADAM15 | A disintegrin and metalloproteinase domain 15 (metargidin) | 5'-AACUCCAUCUGUUCUCCUGACdTdT-3' | 532 |
| NM_021832 | Hs.404914 | ADAM17 | A disintegrin and metalloproteinase domain 17 | 5'-AAAGUUUGCUUGGCACACCUUdTdT-3' | 533 |
| NM_000927.3 | Hs.489033 | ABCB1 | ATP-binding cassette, sub-family B (MDR/TAP), member 1 | 5'-AAG GCC TAA TGC CGA ACA CA-3' | 534 |
| NM_000927.3 | Hs.489033 | ABCB1 | ATP-binding cassette, sub-family B (MDR/TAP), member 1 | 5'-AAC TTT GGC TGC CAT CAT CCA-3' | 535 |
| NM_000572 | Hs.193717 | IL10 | Interleukin 10 | 5'-UAAGCUCCAAGAGAAAGGCdTdT-3' | 536 |
| NM_021975 | Hs.502875 | RELA | V-rel reticuloendotheliosis viral oncogene homolog A | 5'-GCCCUAUCCCUUUACGUCA-3' | 537 |
| NM_001331 | Hs.166011 | CTNND1 | Catenin (cadherin-associated protein), delta 1 | 5'-GTGGACCATGCACTGCATGCCTAT AGTGAGTCGTATTAC-3' | 538 |
| NM_001211 | Hs.36708 | BUB1B | BUB1 budding uninhibited by benzimidazoles 1 homolog beta | 5'-AGATCCTGGCTAACTGTTC-3' | 539 |

-continued

| Accession # | Unigene # | Gene Symbol | Name | Sequence | SEQ ID NO: |
|---|---|---|---|---|---|
| NM_002358 | Hs.533185 | MAD2L1 | MAD2 mitotic arrest deficient-like 1 (yeast) | 5'-TACGGACTCACCTTGCTTG-3' | 540 |
| NM_001530.2 | Hs.509554 | HIF1A | Hypoxia-inducible factor 1, alpha subunit | 5'-CUGGACACAGUGUGUUUGAdTdT-3' | 541 |
| NM_001530.2 | Hs.509554 | HIF1A | Hypoxia-inducible factor 1, alpha subunit | 5'-CUGAUGACCAGCAACUUGAdTdT-3' | 542 |
| NM_001430 | Hs.468410 | EPAS1 | Endothelial PAS domain protein 1 | 5'-GCUCUUCGCCAUGGACACAdTdT-3' | 543 |
| NM_001430 | Hs.468410 | EPAS1 | Endothelial PAS domain protein 1 | 5'-GCGACAGCUGGAGUAUGAAdTdT-3' | 544 |
| NM_001379 | Hs.202672 | DNMT1 | DNA (cytosine-5-)-methyltransferase 1 | 5'-CCAUGAGCACCGUUCUCCUU-3' | 545 |
| NM_031310 | Hs.107125 | PLVAP | Plasmalemma vesicle associated protein | 5'-CUUGACCAAGGAGCUCAACUU-3' | 546 |
| NM_031310 | Hs.107125 | PLVAP | Plasmalemma vesicle associated protein | 5'-GGAGCUCAACUUCACCACCUU-3' | 547 |
| NM_016734 | Hs.126365 | PAX5 | Paired box gene 5 (B-cell lineage specific activator) | 5'-CGGCCACUCGCUUCCGGGCUU-3' | 548 |
| NM_016734 | Hs.126365 | PAX5 | Paired box gene 5 (B-cell lineage specific activator) | 5'-GCUCCGUCGACUGCGCGCC-3' | 549 |
| NM_006257 | Hs.498570 | PRKCQ | Protein kinase C, theta | 5'-AAACCACCGTGGAGCTCTACT-3' | 550 |
| NM_006257 | Hs.498570 | PRKCQ | Protein kinase C, theta | 5'-AAGAGCCCGACCTTCTGTGAA-3' | 551 |
| NM_032430 | Hs.182081 | BRSK1 | BR serine/threonine kinase 1 | 5'-GUU CUU CCG CCA GAU UGU GdTdT-3' | 552 |
| NM_015045 | Hs.203099 | KIAA0261 | KIAA0261 | 5'-CGGACUACCCUUAGCACAAUU-3' | 553 |
| NM_015045 | Hs.203099 | KIAA0261 | KIAA0261 | 5'-GAAUAGUCACCAUAUUCACUU-3' | 554 |
| NM_005430 | Hs.248164 | WNT1 | Wingless-type MMTV integration site family, member 1 | 5'-GGTTCCATCGAATCCTGCA-3' | 555 |
| NM_004421.2 | Hs.74375 | DVL1 | Dishevelled, dsh homolog 1 (Drosophila) | 5'-AACAAGATCACCTTCTCCGAG-3' | 556 |
| NM_004422 | Hs.118640 | DVL2 | Dishevelled, dsh homolog 2 (Drosophila) | 5'-AACTTTGAGAACATGAGCAAC-3' | 557 |
| NM_139049 | Hs.522924 | MAPK8 | Mitogen-activated protein kinase 8 | 5'-CGTGGATTTATGGTCTGTG-3' | 558 |
| NM_003376 | Hs.73793 | VEGF | Vascular endothelial growth factor | 5'-UGGAUGUCUAUCAGCGCAGdTdT-3' | 559 |
| NM_003376 | Hs.73793 | VEGF | Vascular endothelial growth factor | 5'-GCUACUGCCAUCCAAUCGAdTdT-3' | 560 |
| NM_003376 | Hs.73793 | VEGF | Vascular endothelial growth factor | 5'-GGAGUACCCUGAUGAGAUCdTdT-3' | 561 |
| NM_003376 | Hs.73793 | VEGF | Vascular endothelial growth factor | 5'-CUGAGGAGUCCAACAUCACdTdT-3' | 562 |
| NM_003376 | Hs.73793 | VEGF | Vascular endothelial growth factor | 5'-CCAAGGCCAGCACAUAGGAdTdT-3' | 563 |
| NM_005123 | Hs.282735 | NR1H4 | Nuclear receptor subfamily 1, group-H, member 4 | 5'-GTCGTGACTTGCGACAAG-3' | 564 |
| NM_004999 | Hs.149387 | MYO6 | Myosin VI | 5'-GCUGGCAGUUCAUAGGAAUdTdT-3' | 565 |
| NM_004999 | Hs.149387 | MYO6 | Myosin VI | 5'-CGUGCUCCAAAGUCUGUUAdTdT-3' | 566 |

-continued

| Accession # | Unigene # | Gene Symbol | Name | Sequence | SEQ ID NO: |
|---|---|---|---|---|---|
| NM_014865 | Hs.5719 | CNAP1 | Chromosome condensation-related SMC-associated protein 1 | 5'-UCAGUAUGUUGUGCAAGAGUU-3' | 567 |
| NM_014865 | Hs.5719 | CNAP1 | Chromosome condensation-related SMC-associated protein 1 | 5'-GAAGAUACUCUGGAAUUCCUU-3' | 568 |
| NM_015261 | Hs.438550 | KIAA0056 | KIAA0056 protein | 5'-CUGGAUUUCACAGAGACUGUU-3' | 569 |
| NM_015261 | Hs.438550 | KIAA0056 | KIAA0056 protein | 5'-GCAGAGAUCAUAGAGACUGUU-3' | 570 |
| NM_015341 | Hs.308045 | BRRN1 | Barren homolog (Drosophila) | 5'-GACUUUCCUCAGAAUGACGUU-3' | 571 |
| NM_015341 | Hs.308045 | BRRN1 | Barren homolog (Drosophila) | 5'-CAUUACUCCACCUGUAUCAUU-3' | 572 |
| NM_014551 | Hs.180903 | 384D8-2 | Hypothetical protein 384D8_6 | 5'-GGAUUUCAGGAUGAACACGUU-3' | 573 |
| NM_014551 | Hs.180903 | 384D8-2 | Hypothetical protein 384D8_6 | 5'-GCUGCAGGACUUCCACCAGUU-3' | 574 |
| NM_006031 | Hs.474069 | PCNT2 | Pericentrin 2 (kendrin) | 5'-AAUUGGAACAGCUGCAGCAGA-3' | 575 |
| NM_006031 | Hs.474069 | PCNT2 | Pericentrin 2 (kendrin) | 5'-AAGCUCUGAUUUAUCAAAGA-3' | 576 |
| NM_012179.2 | Hs.5912 | FBXO7 | F-box protein 7 | 5'-CCCACACCAUUCCAUUCUA-3' | 577 |
| NM_002467 | Hs.202453 | MYC | V-myc myelocytomatosis viral oncogene homolog (avian) | 5'-AAGAUGAGGAAGAAAUCGAUGUU-3' | 578 |
| NM_002467 | Hs.202453 | MYC | V-myc myelocytomatosis viral oncogene homolog (avian) | 5'-AAAAGGUCAGAGUCUGGAUCACC-3' | 579 |
| NM_002467 | Hs.202453 | MYC | V-myc myelocytomatosis viral oncogene homolog (avian) | 5'-CACGUCUCCACACAUCAGCACAA-3' | 580 |
| NM_002467 | Hs.202453 | MYC | V-myc myelocytomatosis viral oncogene homolog (avian) | 5'-AAAUGAGAUAAAGGUGGCUAAUU-3' | 581 |
| NM_002392 | Hs.369849 | MDM2 | Mdm2, transformed 3T3 cell double minute 2, p53 binding protein | 5'-UGGUUGCAUUGUCCAUGGC-3' | 582 |
| NM_003121 | Hs.437905 | SPIB | Spi-B transcription factor (Spi-1/PU.1 related) | 5'-GATCGCTGTGTGTCTGTAA-3' | 583 |
| NM_003120.1 | Hs.502511 | SPI1 | Spleen focus forming virus (SFFV) proviral integration oncogene spi1 | 5'-GTCCGTATGTAAATCAGAT-3' | 584 |
| NM_199002 | Hs.278186 | ARHGEF1 | Rho guanine nucleotide exchange factor (GEF) 1 | 5'-CATACCATCTCTACCGACG-3' | 585 |
| NM_014784 | Hs.516954 | ARHGEF11 | Rho guanine nucleotide exchange factor (GEF) 11 | 5'-ACTGAAGTCTCGGCCAGCT-3' | 586 |
| NM_015313 | Hs.24598 | ARHGEF12 | Rho guanine nucleotide exchange factor (GEF) 12 | 5'-GAAACTCGTCGCATCTTCC-3' | 587 |
| NM_173842 | Hs.81134 | IL1RN | Interleukin 1 receptor antagonist | 5'-AUCUGCAGAGGCCUCCGCAtt-3' | 588 |
| NM_032726 | Hs.549218 | PLCD4 | Phospholipase C, delta 4 | 5'-GAGCAGAACCUUCAGAAUAdTdT-3' | 589 |
| NM_032726 | Hs.549218 | PLCD4 | Phospholipase C, delta 4 | 5'-GAGCAGGGCUUCACCAUUGdTdT-3' | 590 |
| NM_032726 | Hs.549218 | PLCD4 | Phospholipase C, delta 4 | 5'-GGAAGGAGAAGAAUUCGUAdTdT-3' | 591 |
| NM_032726 | Hs.549218 | PLCD4 | Phospholipase C, delta 4 | 5'-GAUAUCAUCUUUCUCUGAAdTdT-3' | 592 |
| NM_004104 | Hs.83190 | FASN | Fatty acid synthase | 5'-CAACUACGGCUUUGCCAAU-3' | 593 |
| NM_004104 | Hs.83190 | FASN | Fatty acid synthase | 5'-GCAACUCACGCUCCGGAAA-3' | 594 |
| NM_004104 | Hs.83190 | FASN | Fatty acid synthase | 5'-GCCCUGAGCUGGACUACUU-3' | 595 |
| NM_004104 | Hs.83190 | FASN | Fatty acid synthase | 5'-GGUAUGCGACGGGAAAGUA-3' | 596 |

-continued

| Accession # | Unigene # | Gene Symbol | Name | Sequence | SEQ ID NO: |
|---|---|---|---|---|---|
| NM_002165.2 | Hs.504609 | ID1 | Inhibitor of DNA binding 1, dominant negative helix-loop-helix protein | 5'-AACTCGGAATCCGAAGTTGGA-3' | 597 |
| NM_003200.1 | Hs.371282 | TCF3 | Transcription factor 3 | 5'-AAAGACCTGAGGGACCGGGAG-3' | 598 |
| NM_015895 | Hs.234896 | GMNN | Geminin, DNA replication inhibitor | 5'-GAGAAAATGAGCTGTCCGC-3' | 599 |
| NM_015895 | Hs.234896 | GMNN | Geminin, DNA replication inhibitor | 5'-CTGGCAGAAGTAGCAGAAC-3' | 600 |
| NM_006704 | Hs.281902 | SUGT1 | SGT1, suppressor of G2 allele of SKP1 (*S. cerevisiae*) | 5'-AAGGCUUUGGAACAGAAACCA-3' | 601 |
| NM_002358 | Hs.533185 | MAD2L1 | MAD2 mitotic arrest deficient-like 1 | 5'-AAGAGUCGGGACCACAGUUUA-3' | 602 |
| NM_006472 | Hs.533977 | TXNIP | Thioredoxin interacting protein | 5'-ACAGACUUCGGAGUACCUGdTT-3' | 603 |
| NM_001379- | Hs.202672 | DNMT1 | DNA (cytosine-5-)-methyltransferase 1 | 5'-CGGUGCUCAUGCUUACAACUU-3' | 604 |
| NM_001379 | Hs.202672 | DNMT1 | DNA (cytosine-5-)-methyltransferase 1 | 5'-CGAGUUGCUAGACCGCUUCUU-3' | 605 |
| NM_006838 | Hs.444286 | METAP2 | Methionyl aminopeptidase 2 | 5'-AAUGCCGGUGACACAACAUGA-3' | 606 |
| NM_007862.2 | Mm.382 | Dlgh1 | Discs, large homolog 1 (*Drosophila*) | 5'-TACGGGAGCAGATGATGAAA-3' | 607 |
| NM_007862.2 | Mm.382 | Dlgh1 | Discs, large homolog 1 (*Drosophila*) | 5'-AACCCAAATCCATGGAAAATA-3' | 608 |
| NM_008173.1 | Mm.129481 | Nr3c1 | Nuclear receptor subfamily 3, group C, member 1 | 5'-GAGCAGTGGAAGGACAGCATTCAA GAGATGCTGTCCTTCCACTGCTCTTTTTT-3' | 609 |
| NM_008173.1 | Mm.129481 | Nr3c1 | Nuclear receptor subfamily 3, group C, member 1 | 5'-GATCCCGAGCAGTGGAAGGACAGCATTCAA GAGATGCTGTCCTTCCACTGCTCTTTTTTGG AAA-3' | 610 |
| NM_007871.1 | Mm.39292 | Dnm2 | Dynamin 2 | 5'-GGACCAGGCAGAGAATGAG-3' | 611 |
| NM_011155.1 | Mm.3294 | ppp5c | Protein phosphatase 5, catalytic subunit | 5'-AAG ACA CAG GCC AAC GAC UAC-3' | 612 |
| NM_011155.1 | Mm.3294 | Ppp5c | Protein phosphatase 5, catalytic subunit | 5'-AAG AUU GUG AAG CAG AAG GCC-3' | 613 |
| NM_009263.1 | Mm.288474 | Spp1 | Secreted phosphoprotein 1 | 5'-AATCTCCTTGCGCCACAGAAT-3' | 614 |
| NM_009263.1 | Mm.288474 | Spp1 | Secreted phosphoprotein 1 | 5'-AAGTCAGCTGGATGAACCAAG-3' | 615 |
| NM_145978.1 | Mm.283968 | Pdlim2 | PDZ and LIM domain 2 | 5'-AAGAUCCGACAGAGCGCCUCA-3' | 616 |
| NM_146386.1 | Mm.32257 | Myocd | Myocardin | 5'-AATGCAACTGCAGAAGCAGAA-3' | 617 |
| NM_145541.3 | Mm.333868 | Rap1a | RAS-related protein-1a | 5'-AAGCAAGTCGAGGTAGATTGC-3' | 618 |
| NM_010026.1 | Mm.277236 | Ddef1 | RIKEN cDNA 1700010G06 gene | 5'-CAGCUAACUGCACUCCGAG-3' | 619 |
| NM_010026.1 | Mm.277236 | Ddef1 | RIKEN cDNA 1700010G06 gene | 5'-UGAUAUUAUGGAAGCAAAU-3' | 620 |
| NM_007614.2 | Mm.291928 | Catnb | Catenin beta | 5'-AAGGCTTTTCCCAGTCCTTCA-3' | 621 |
| NM_007614.2 | Mm.291928 | Catnb | Catenin beta | 5'-AAGATGATGGTGTGCCAAGTG-3' | 622 |
| NM_011952.1 | Mm.8385 | Mapk3 | Mitogen activated protein kinase 3 | 5'-AATGTTATAGGCATCCGAGAC-3' | 623 |
| NM_011952.1 | Mm.8385 | Mapk3 | Mitogen activated protein kinase 3 | 5'-AACCCAAACAAGCGCATCACA-3' | 624 |

-continued

| Accession # | Unigene # | Gene Symbol | Name | Sequence | SEQ ID NO: |
|---|---|---|---|---|---|
| NM_011949.2 | Mm.196581 | Mapk1 | Mitogen activated protein kinase 1 | 5'-AAAGTTCGAGTTGCTATCAAG-3' | 625 |
| NM_010591.1 | Mm.275071 | Jun | Jun oncogene | 5'-GCGCATGAGGAACCGCATT-3' | 626 |
| NM_008416.1 | Mm.1167 | Junb | Jun-B oncogene | 5'-GACCAGGAGCGCATCAAAG-3' | 627 |
| NM_010592.3 | Mm.1175 | Jund1 | Jun proto-oncogene related gene d1 | 5'-AAGCCAGAACACCGAGCTG-3' | 628 |
| NM_010234.2 | Mm.246513 | Fos | FBJ osteosarcoma related oncogene | 5'-GCGGAGACAGATCAACTTG-3' | 629 |
| NM_010235.1 | Mm.6215 | fosl1 | Fos-like antigen 1 | 5'-ATTGGAGGATGAGAAATCG-3' | 630 |
| NM_008037.3 | Mm.24684 | Fosl2 | Fos-like antigen 2 | 5'-TCAACGCCATCACCACCAG-3' | 631 |
| NM_009505.2 | Mm.282184 | Vegfa | Vascular endothelial growth factor A | 5'-AACGAUGAAGCCCUGGAGUGC-3' | 632 |
| NM_015774.2 | Mm.264435 | Ero1l | ERO1-like (*S. cerevisiae*) | 5'-ACTTCATCAGAATGGCAGGGTTT-3' | 633 |
| NM_021450.1 | Mm.244705 | Trpm7 | Transient receptor potential cation channel, subfamily M, member 7 | 5'-AACCGGAGGTCAGGTCGAAAT-3' | 634 |
| NM_021450.1 | Mm.244705 | Trpm7 | Transient receptor potential cation channel, subfamily M, member 7 | 5'-AAGCAGAGTGACCTGGTAGAT-3 | 635 |
| NM_177407.2 | Mm.131530 | Camk2a | Calcium/calmodulin-dependent protein kinase II alpha | 5'-CACCACCAUUGAGGACGAAdTdT-3' | 636 |
| NM_010118.1 | Mm.290421 | Egr2 | Early growth response 2 | 5'-GUGCCACCUUACUACUCAdTdT-3' | 637 |
| NM_010118.1 | Mm.290421 | Egr2 | Early growth response 2 | 5'-GUUUGCCAGGAGUGACGAAdTdT-3' | 638 |
| NM_015806.2 | Mm.18856 | Mapk6 | Mitogen-activated protein kinase 6 | 5'-GGCUUUUCAUGUAUCAGCUTT-3' | 639 |
| NM_015806.2 | Mm.18856 | Mapk6 | Mitogen-activated protein kinase 6 | 5'-GGCAAUGGCUUGGUUUUUUTT-3' | 640 |
| NM_015806.2 | Mm.18856 | Mapk6 | Mitogen-activated protein kinase 6 | 5'-GGAGUACAUGGAGACAGACTT-3' | 641 |
| NM_009744.2 | Mm.347398 | Bcl6 | B-cell leukemia/lymphoma 6 | 5'-GTCGAGACATCTTGACTGA-3' | 642 |
| NM_009744.2 | Mm.347398 | Bcl6 | B-cell leukemia/lymphoma 6 | 5'-GACACGGATCTGAGAATCT-3' | 643 |
| NM_145533.1 | Mm.136586 | Smox | Spermine oxidase | 5'-GGACGUGGUUGAGGAAUUC-3' | 644 |
| NM_008778.1 | Mm.40035 | Pak3 | P21 (CDKN1A)-activated kinase 3 | 5'-TAGCAGCACATCAGTCGAATA-3' | 645 |
| NM_008778.1 | Mm.40035 | Pak3 | P21 (CDKN1A)-activated kinase 3 | 5'-CCCAATATTGTCAATTATTTA-3' | 646 |
| NM_080428.2 | Mm.196475 | Fbxw7 | F-box and WD-40 domain protein 7, archipelago homolog | 5'-CACAAAGCTGGTGTGTGCA-3' | 647 |
| NM_021450.1 | Mm.244705 | Trpm7 | Transient receptor potential cation channel, subfamily M, member 7 | 5'-AACCGGAGGTCAGGTCGAAAT-3' | 648 |
| NM_021450.1 | Mm.244705 | Trpm7 | Transient receptor potential cation channel, subfamily M, member 7 | 5'-AAGCAGAGTGACCTGGTAGAT-3' | 649 |
| NM_009505.2 | Mm.282184 | Vegfa | Vascular endothelial growth factor A | 5'-AAGCCGTCCTGTGTGCCGCTG-3' | 650 |
| NM_009505.2 | Mm.282184 | Vegfa | Vascular endothelial growth factor A | 5'-AACGATGAAGCCCTGGAGTGC-3' | 651 |

-continued

| Accession # | Unigene # | Gene Symbol | Name | Sequence | SEQ ID NO: |
|---|---|---|---|---|---|
| NM_010228.2 | Mm.3464 | Flt1 | FMS-like tyrosine kinase 1 | 5'-AAGTTAAAAGTGCCTGAACTG-3' | 652 |
| NM_010228.2 | Mm.3464 | Flt1 | FMS-like tyrosine kinase 1 | 5'-AAGCAGGCCAGACTCTCTTTC-3' | 653 |
| NM_010612.2 | Mm.285 | Kdr | Kinase insert domain protein receptor | 5'-AAGCTCAGCACACAGAAAGAC-3' | 654 |
| NM_010612.2 | Mm.285 | Kdr | Kinase insert domain protein receptor | 5'-AATGCGGCGGTGGTGACAGTA-3' | 655 |
| AK019429.1 | Mm.3049 | Cks1b | CDC28 protein kinase 1b | 5'-GGGACATAGCCAAGCTGGTCgagtactg GACCAGCTTGGCTATGTCC-3' | 656 |
| NM_008000.1 | Mm.280819 | Fert2 | Fer (fms/fps related) protein kinase, testis specific 2 | 5'-AAC TAC GGT TGC TGG AGA CAG-3' | 657 |
| NM_009750.1 | Mm.90787 | Ngfrap 1 | Nerve growth factor receptor (TNFRSF16) associated protein 1 | 5'-CAACAACCACAACCATAAC-3' | 658 |
| NM_009750.1 | Mm.90787 | Ngfrap1 | Nerve growth factor receptor (TNFRSF16) associated protein 1 | 5'-CATAACCACAACCACCACTdTdT-3' | 659 |
| NM_010431.1 | Mm.3879 | Hif1a | Hypoxia inducible factor 1, alpha subunit | 5'-TGTGAGCTCACATCTTGAT-3' | 660 |
| NM_010838 | Mm.1287 | Mapt | Microtubule-associated protein tau | 5'-CCAGGAGTTTGACACAATG-3' | 661 |
| NM_009045 | Mm.249966 | Rela | V-rel reticuloendotheliosis viral oncogene homolog A | 5'-GATCAATGGCTACACAGGA-3' | 662 |
| NM_009689 | Mm.8552 | Birc5 | Baculoviral IAP repeat-containing 5 | 5'-GAGCCAAGAACAAAATTGC-3' | 663 |
| NM_009689 | Mm.8552 | Birc5 | Baculoviral IAP repeat-containing 5 | 5'-GAAAGTGCGCCGTGCCATC-3' | 664 |
| NM_007798.1 | Mm.236553 | CTSB | Cathepsin B | 5'-CCACUGUGGCAUUGAAUCAUU-3' | 665 |
| NM_011960 | Mm.15962 | Parg | Poly (ADP-ribose) glycohydrolase | 5'-AACGCCACCTCGTTTGTTTTC-3' | 666 |
| NM_010928.1 | Mm.254017 | Notch2 | Notch gene homolog 2 | 5'-GAUGUGGACAGUGUCUGUTT-3' | 667 |
| NM_019984 | Mm.41964 | Tgm1 | Transglutaminase 1, K polypeptide | 5'-AUGCAGCUGGAGAUGGCACdTdT-3' | 668 |
| NM_009593 | Mm.15691 | Abcg1 | ATP-binding cassette, sub-family G (WHITE), member 1 | 5'-CGTGGATGAGGTTGAGACA-3' | 669 |
| NM_009593 | Mm.15691 | Abcg1 | ATP-binding cassette, sub-family G (WHITE), member 1 | 5'-GGTGGACAACAACTTCACA-3' | 670 |
| NM_138955 | Mm.101876 | Abcg4 | ATP-binding cassette, sub-family G (WHITE), member 4 | 5'-GAAGGTGGAGAACCATATC-3' | 671 |
| NM_138955 | Mm.101876 | Abcg4 | ATP-binding cassette, sub-family G (WHITE), member 4 | 5'-GCACTTGAACTACTGGTAT-3' | 672 |
| NM_011658 | Mm.3280 | Twist1 | Twist gene homolog 1 | 5'-AAGCTGAGCAAGATTCAGACC-3' | 673 |
| NM_011658 | Mm.3280 | Twist1 | Twist gene homolog 1 | 5'-AGGTACATCGACTTCCTGTAC-3' | 674 |
| NM_011658 | Mm.3280 | Twist1 | Twist gene homolog 1 | 5'-AGCGGGTCATGGCTAACGTGC-3' | 675 |
| NM_009537 | Mm.3868 | Yy1 | YY1 transcription factor | 5'-GGGAGCAGAAGCAGGUGCAGAU-3' | 676 |
| NM_172689 | Mm.86382 | Ddx58 | DEAD (Asp-Glu-Ala-Asp) box polypeptide 58 | 5'-GCCCATTGAAACCAAGAAATT-3' | 677 |
| NM_008500.1 | IMm.12881 | Lhx6 | LIM homeobox protein 6 | 5'-AGACGCAGAGGCCTTGGTTCAAGAGAC CAAGGCCTCTGCGTCTGACTTTTTC-3' | 678 |

-continued

| Accession # | Unigene # | Gene Symbol | Name | Sequence | SEQ ID NO: |
|---|---|---|---|---|---|
| NM_009308 | Mm.233846 | Syt4 | Synaptotagmin 4 | 5'-r(GAAGCACAGAGUGAAGACCA)d(TT)-3' | 679 |
| NM_009308 | Mm.233846 | Syt4 | Synaptotagmin 4 | 5'-r(CGAGCAGGAGA ACAGCGAG)d(T T)-3' | 680 |
| NM_007615.1 | Mm.35738 | Catns | Expressed sequence AI225934 | 5'-GATGGTTATCCAGGTGGCA-3' | 681 |
| NM_007614.2 | Mm.291928 | Catnb | Catenin beta | 5'-CUGUUGUGGUUAAACUCCUTT-3' | 682 |
| NM_011232 | Mm.38376 | Rad1 | RAD1 homolog (*S. pombe*) | 5'-GCCTTGACAACGTTAGGAATC-3' | 683 |
| NM_011232 | Mm.38376 | Rad1 | RAD1 homolog (*S. pombe*) | 5'-GCAGGAAGTTCCCACCTTGAC-3' | 684 |
| NM_011232 | Mm.38376 | Rad1 | RAD1 homolog (*S. pombe*) | 5'-GCCTGATGAAGAAGTTCC-3' | 685 |
| NM_010423 | Mm.29581 | Hcy1 | Hairy/enhancer-of-split related with YRPW motif 1 | 5'-GCTAGAAAAGCTGAGATC-3' | 686 |
| NM_010133 | Mm.2657 | En1 | Engrailed 1 | 5'-CAUCCUAAGGCCCGAUUUCTT-3' | 687 |
| NM_010133 | Mm.2657 | En1 | Engrailed 1 | 5'-GUUCCCGGAACACAACCCUTT-3' | 688 |
| NM_019390 | Mm.243014 | Lmna | Lamin A | 5'-GCAGCUUCAGGAUGAGAUGTT-3' | 689 |
| NM_183355.1 | Mm.43358 | Pbx1 | Pre B-cell leukemia transcription factor 1 | 5'-CAGUUUUGAGUAUUCGGGGTT-3' | 690 |
| NM_007430 | Mm.5180 | Nr0b1 | Nuclear receptor subfamily 0, group B, member 1 | 5'-GAUCACCUGCACUUCGAGdTdT-3' | 691 |
| NM_007430 | Mm.5180 | Nr0b1 | Nuclear receptor subfamily 0, group B, member 1 | 5'-CUGAACAGUGCCCUUUUCCdTdT-3' | 692 |
| NM_172203 | Mm.233865 | Nox1 | NADPH oxidase 1 | 5'-TTATGAGAAGTCTGACAAG-3' | 693 |
| NM_172203 | Mm.233865 | Nox1 | NADPH oxidase 1 | 5'-GATTCTTGGCTAAATCCCA-3' | 694 |
| NM_172203 | Mm.233865 | Nox1 | NADPH oxidase 1 | 5'-GGACATTTGAACAACAGCA-3' | 695 |
| NM_080850 | Mm.253287 | Pask | PAS domain containing serine/threonine kinase | 5'-AATTTATGGAGTCAACCACAGCTT-3' | 696 |
| NM_009330 | Mm.7226 | Tcf2 | Transcription factor 2 | 5'-GCCGGUUUUCCAUACUCUCtt-3' | 697 |
| NM_009330 | Mm.7226 | Tcf2 | Transcription factor 2 | 5'-CAAGAAGAUGCGCC GCAACtt-3' | 698 |
| NM_009330 | Mm.7226 | Tcf2 | Transcription factor 2 | 5'-UGGUGGUCACAGA UACCAGtt-3' | 699 |
| NM_024148.1 | Rn.5949 | Apex1 | Apurinic/apyrimidinic endonuclease 1 | 5'-GUCUGGUAAGACUGGAGUACC-3' | 700 |
| NM_017059.1 | Rn.10668 | Bax | Bcl2-associated X protein | 5'-UUGGAGAUGAACUGGACAAUU-3' | 701 |
| NM_017059.1 | Rn.10668 | Bax | Bcl2-associated X protein | 5'-CUG GAC AAU AAU AUG GAG CUU-3' | 702 |
| NM_023979.1 | Rn.64522 | Apaf1 | Apoptotic protease activating factor 1 | 5'-AGA ACU UUG UGC UUU AAU GUU-3' | 703 |
| NM_023979.1 | Rn.64522 | Apaf1 | Apoptotic protease activating factor 1 | 5'-UAU AGG CAU AUA CUG GAU GUU-3' | 704 |
| NM_021835.2 | Rn.93714 | Jun | V-jun sarcoma virus 17 oncogene homolog (avian) | 5'-AGU GAA AAC CUU GAA AGC GUU-3' | 705 |
| NM_021835.2 | Rn.93714 | Jun | V-jun sarcoma virus 17 oncogene homolog (avian) | 5'-AGU CAU GAA CCA CGU UAA CUU-3' | 706 |
| NM_012655.1 | Rn.44609 | Sp1 | Sp1 transcription factor | AATGAGAACAGCAACAACTCC | 707 |
| XM_230974.2 | Rn.102138 | Sp3 | Sp3 transcription factor | AAGTTCTCAGACAATGACTGC | 708 |

-continued

| Accession # | Unigene # | Gene Symbol | Name | Sequence | SEQ ID NO: |
|---|---|---|---|---|---|
| NM_133551.1 | Rn.10162 | Pla2g4a | Phospholipase A2, group IVA (cytosolic, calcium-dependent) | 5'-TCGAGACAGTAGTGGTTCTACGTGCCgagt actg | 709 |
| NM_001003959.1 | Rn.117353 | Dnmt3b | DNA methyltransferase 3B | 5'-AGAUGACAGGUGCCCAGAGUU-3' | 710 |
| NM_019335.1 | Rn. 10022 | Prkr | Protein kinase, interferon-inducible double stranded RNA dependent | 5-GGUAGAUCAAAGCAGGAGGTT-3' | 711 |
| NM_053622.1 | Rn.10474 | Pom121 | Nuclear pore membrane glycoprotein 121 kD | 5'-AACGGAGUCCCUGCUGCAUUUdTdT-3' | 712 |
| NM_053622.1 | Rn. 10474 | Pom121 | Nuclear pore membrane | 5'-AACCAUGUCACCAGUCCAGUUdTdT-3' | 713 |
| NM_053622.1 | Rn. 10474 | Pom121 | Nuclear pore membrane glycoprotein 121 kD | 5'-AAGCCUGUGUUUGGCUUUGGAdTdT-3' | 714 |
| NM_131907.2 | Rn.5805 | Atp2c1 | ATPase, Ca++-sequestering | 5'-AACCAUUAUGGAAGAAGUACAUU-3' | 715 |
| NM_031337.1 | Rn.22706 | Siat9 | Sialyltransferase 9 | 5'-GGGUUAUUCUGAACAUGUUtt-3' | 716 |
| NM_031010.2 | Rn.11318 | Alox15 | Arachidonate 12-lipoxygenase | 5'-GCAACTGGATTTCTGTGAAGG-3' | 717 |
| NM_031010.2 | Rn.11318 | Alox15 | Arachidonate 12-lipoxygenase | 5'-GAAGCGGATTTCTTCCTTCTG-3' | 718 |
| NM_031556.1 | Rn.22518 | Cav | Caveolin | 5'-AAGGAGATCGACCTGGTCAAC-3' | 719 |
| NM_031556.1 | Rn.22518 | Cav | Caveolin | 5'-AAGGGACACACAGTTTTGACG-3' | 720 |
| XM_232106.2 | Rn.117974 | Dok-1 | Docking protein 1 (predicted) | 5'-GAACTACACAAATTCAGCCAGGCGTA TCATCCGGTGTTTCGTCCTTTCCACAAG-3' | 721 |
| NM_133307.1 | Rn.98279 | Prkcd | Protein kinase C, delta | 5'-AAAAGGCAAATTCACAAACAGCCTGTC TC-3' | 722 |
| NM_133307.1 | Rn.98279 | Prkcd | Protein kinase C, delta | 5'-AAGTTCTCCGAAGTGTGAGAACCTGT CTC-3' | 723 |
| NM_012637.1 | Rn.11317 | Ptpn1 | Protein tyrosine phosphatase, non-receptor type 1 | 5'-AAGCTGACACTGATCTCTGAA-3' | 724 |
| NM_017212 | Rn.2455 | Mapt | Microtubule-associated protein tau | 5'-CCAGGAGTTTGACACAATG-3' | 725 |
| NM_013156 | Rn.1294 | CTSL | Cathepsin L | 540 -GGACAGAUGUUCCUUAAGAUU-3' | 726 |
| NM_012576.1 | Rn.90070 | Nr3c1 | Nuclear receptor subfamily 3, group C, member 1 | 5'-GGCCAAGGGAGGGGGAGCGTA-3' | 727 |
| NM_013131.1 | Rn.9678 | Nr3c2 | Nuclear receptor subfamily 3, group C, member 2 | 5'-GGCGCTGGAGTCAAGTGTCTC-3' | 728 |
| NM_031659 | Rn. 10039 | Tgm1 | Transglutaminase 1 | 5'-AUGCAGCUGGAGAUGGCACdTdT-3' | 729 |
| NM_019275 | Rn.9774 | Madh4 | MAD homolog 4 | 5'-AAUACACCGACAAGCAAUGACdTdT-3' | 730 |
| NM_031132 | Rn.9954 | Tgfbr2 | Transforming growth factor, beta receptor II | 5'-AAAGUCGGUUAACAGCGAUCUdTdT-3' | 731 |
| NM_144741 | Rn. 16746 | Retn | Resistin | 5'-CCTTTCATTTCTCCTCCTT-3' | 732 |
| NM_144741 | Rn. 16746 | Retn | Resistin | 5'-AGCTGCTCCTGTGGCTCTG-3' | 733 |
| NM_144741 | Rn. 16746 | Retn | Resistin | 5'-GCCTCCTGCCCAGAAGGCA-3' | 734 |
| NM_012614 | Rn.9714 | Npy | Neuropeptide Y | 5'-UGAGAGAAAGCACAGAAA-3' | 735 |
| NM_021597 | Rn.35512 | Eif2c2 | GKRp95 | 5'-UGGACAUCCCCAAAAUUGA-3' | 736 |
| NM_012547 | Rn.87299 | Drd2 | Dopamine receptor 2 | 5'-CCCCAUCAUCUACACCACA-3' | 737 |

Appendix (B)

TABLE 1

Oligonucleotide Stimulation of Mouse B Cells

| ODN | | | Stimulation Index[1] | |
|---|---|---|---|---|
| | Production | Sequence (5' to 3')† | ³H Uridine | IgM |
| 1 | (SEQ ID NO: 1) | GCTAGACGTTAGCGT | 6.1 ± 0.8 | 17.9 ± 3.6 |
| 1a | (SEQ ID NO: 42) | ......T........ | 1.2 ± 0.2 | 1.7 ± 0.5 |
| 1b | (SEQ ID NO: 43) | ......Z........ | 1.2 ± 0.1 | 1.8 ± 0.0 |
| 1c | (SEQ ID NO: 4) | ............Z.. | 10.3 ± 4.4 | 9.5 ± 1.8 |
| 1d | (SEQ ID NO: 5) | ..AT......GAGC. | 13.0 ± 2.3 | 18.3 ± 7.5 |
| 2 | (SEQ ID NO: 6) | ATGGAAGGTCCAGCGTTCTC | 2.9 ± 0.2 | 13.6 ± 2.0 |
| 2a | (SEQ ID NO: 7) | ..C..CTC..G........ | 7.7 ± 0.8 | 24.2 ± 3.2 |
| 2b | (SEQ ID NO: 8) | ..Z..CTC..ZG..Z..... | 1.6 ± 0.5 | 2.8 ± 2.2 |
| 2c | (SEQ ID NO: 9) | ..Z..CTC..G........ | 3.1 ± 0.6 | 7.3 ± 1.4 |
| 2d | (SEQ ID NO: 10) | ..C..CTC..G......Z.. | 7.4 ± 1.4 | 27.7 ± 5.4 |
| 2e | (SEQ ID NO: 740) | ............A....... | 5.6 ± 2.0 | ND |
| 3D | (SEQ ID NO: 12) | GAGAACGCTGGACCTTCCAT | 4.9 ± 0.5 | 19.9 ± 3.6 |
| 3Da | (SEQ ID NO: 13) | ........C......... | 6.6 ± 1.5 | 33.9 ± 6.8 |
| 3Db | (SEQ ID NO: 14) | ........C......G.. | 10.1 ± 2.8 | 25.4 ± 0.8 |
| 3Dc | (SEQ ID NO: 15) | ...C.A............ | 1.0 ± 0.1 | 1.2 ± 0.5 |
| 3Dd | (SEQ ID NO: 17) | .....Z............ | 1.2 ± 0.2 | 1.0 ± 0.4 |
| 3De | (SEQ ID NO: 12) | ............Z..... | 4.4 ± 1.2 | 18.8 ± 4.4 |
| 3Df | (SEQ ID NO: 18) | ......A........... | 1.6 ± 0.1 | 7.7 ± 0.4 |
| 3Dg | (SEQ ID NO: 19) | ........CC.G.ACTG.. | 6.1 ± 1.5 | 18.6 ± 1.5 |
| 3M | (SEQ ID NO: 22) | TCCATGTCGGTCCTGATGCT | 4.1 ± 0.2 | 23.2 ± 4.9 |
| 3Ma | (SEQ ID NO: 21) | ......CT.......... | 0.9 ± 0.1 | 1.8 ± 0.5 |
| 3Mb | (SEQ ID NO: 22) | ........Z.......... | 1.3 ± 0.3 | 1.5 ± 0.6 |
| 3Mc | (SEQ ID NO: 23) | ..........Z........ | 5.4 ± 1.5 | 8.5 ± 2.6 |
| 3Md | (SEQ ID NO: 24) | ......A..T......... | 17.2 ± 9.4 | ND |
| 3Me | (SEQ ID NO: 741) | ...........C..A. | 3.6 ± 0.2 | 14.2 ± 5.2 |
| 4 | (SEQ ID NO: 26) | TCAACGTT | 6.1 ± 1.4 | 19.2 ± 5.2 |
| 4a | (SEQ ID NO: 27) | ....GC.. | 1.1 ± 0.2 | 1.5 ± 1.1 |
| 4b | (SEQ ID NO: 28) | ...GCGC. | 4.5 ± 0.2 | 9.6 ± 3.4 |
| 4c | (SEQ ID NO: 2306) | ...TCGA. | 2.7 ± 1.0 | ND |
| 4d | (SEQ ID NO: 30) | ..TT..AA | 1.3 ± 0.2 | ND |
| 4e | (SEQ ID NO: 31) | -....... | 1.3 ± 0.2 | 1.1 ± 0.5 |
| 4f | (SEQ ID NO: 32) | C....... | 3.9 ± 1.4 | ND |

TABLE 1-continued

Oligonucleotide Stimulation of Mouse B Cells

| ODN Production | Sequence (5' to 3')† | Stimulation Index[1] | |
|---|---|---|---|
| | | ³H Uridine | IgM |
| 4g | --......CT (SEQ ID NO: 2307) | 1.4 ± 0.3 | ND |
| 4h | ........C (SEQ ID NO: 34) | 1.2 ± 0.2 | ND |
| LPS | | 7.8 ± 2.8 | 4.8 ± 1.0 |

[1]Stimulation indexes are the means and std. dev. derived from at least 3 separate experiments, and are compared to wells cultured with no added ODN.
ND = not done.
CpG dinucleotides are underlined.
Dots indicate identity; dashes indicate deletion.
Z indicates 5 methyl cytonine.

TABLE 2

Identification of the optimal CpG motif for Nurine XL-6 production and B cell activation.

| ODN (ng/ml)[c] | SEQUENCE (5'-3') | IL-6 (pg/ml)[a] | | SI[b] | IgM |
|---|---|---|---|---|---|
| | | CH12.LX | SPLENIC B CELL | | |
| 512 (SEQ ID No: 22) | TCCATGTCGGTCCTGATGCT | 1300 ± 106 | 627 ± 43 | 5.8 ± 0.3 | 7315 ± 1324 |
| 1637 (SEQ ID No: 43) | ......C............ | 136 ± 27 | 46 ± 6 | 1.7 ± 0.2 | 770 ± 72 |
| 1615 (SEQ ID No: 44) | ......G............ | 1201 ± 155 | 850 ± 202 | 3.7 ± 0.3 | 3212 ± 617 |
| 1614 (SEQ ID No: 45) | ......A............ | 1533 ± 321 | 1812 ± 103 | 10.8 ± 0.6 | 7558 ± 414 |
| 1636 (SEQ ID No: 46) | ........a.......... | 1181 ± 76 | 947 ± 132 | 5.4 ± 0.4 | 3983 ± 485 |
| 1634 (SEQ ID No: 47) | ........c.......... | 1049 ± 223 | 1671 ± 175 | 9.2 ± 0.9 | 6256 ± 261 |
| 1619 (SEQ ID No: 48) | ........T.......... | 1555 ± 304 | 2908 ± 129 | 12.5 ± 1.0 | 8243 ± 698 |
| 1618 (SEQ ID No: 24) | ......A..T......... | 2109 ± 291 | 2596 ± 166 | 12.9 ± 0.7 | 10425 ± 674 |
| 1639 (SEQ ID No: 49) | .....AA..T......... | 1827 ± 83 | 2012 ± 132 | 11.5 ± 0.4 | 9439 ± 103 |
| 1707 (SEQ ID No: 50) | ......A..TC........ | ND | 1147 ± 175 | 4.0 ± 0.2 | 3534 ± 217 |
| 1708 (SEQ ID No: 51) | .....CA..TG........ | ND | 59 ± 3 | 1.5 ± 0.1 | 466 ± 109 |

Dots indicate identity;
CpG dinucleotides are underlined;
ND = not done
[a]The experiment was done at least three times with similar results. The level of IL-6 of unstimulated control enleures of both CB32.LX and splenic B cells was % in pg/ml. The IgM level of unstimulated culture was 547 ± 82 ng/ml. CpG dinucleotides are underlined and dots indicate identity.
[b][³H] Uridine uptake was indicated as a fold increase (SI: stimulation index) from unstimulated control (2322.67 ± 213.68 cpa). Calls were stimulated with 20 μM of various CpG O-QDN. Data present the mean ± SD of triplicates
[c]Measured by ELISA.

TABLE 3

Induction of Murine IL-6 secretion by CpG motifs in bacterial DNA or oligonucleotides.

| Treatment | IL-6 (pg/ml) |
|---|---|
| calf thymus DNA | ≤10 |
| calf thymus DNA + DNase | ≤10 |
| E. coli DNA | 1169.5 ± 94.1 |
| E. coli DNA + DNase | ≤10 |
| CpG methyl-ated E. coli DNA | ≤10 |
| LPS | 280.1 ± 17.1 |
| Media (no DNA) | ≤10 |
| ODN | |
| 5a  SEQ. ID. No: 35   ATGGACTCTCCAGCGTTCTC | 1096.4 ± 372.0 |

TABLE 3-continued

Induction of Murine IL-6 secretion by CpG motifs in bacterial DNA or oligonucleotides.

| | Treatment | | IL-6 (pg/ml) |
|---|---|---|---|
| 5b | SEQ. ID. No: 740 | .....AGG....A....... | 1124.5 ± 126.2 |
| 5c | SEQ. ID. No: 7 | ..C......G......... | 1783.0 ± 189.5 |
| 5d | SEQ. ID. No: 742 | ....AGG..C..T...... | ≤10 |
| 5e | SEQ. ID. No: 8 | ..C......G..Z...... | 851.1 ± 114.4 |
| 5f | SEQ. ID. No: 9 | ..Z......ZG..Z...... | ≤10 |
| 5g | SEQ. ID. No: 10 | ..C......G......Z.. | 1862.3 ± 87.26 |

TABLE 5

Induction of human PBMC cytokine secretion by CpG oligos

| ODN | Sequence (5'-3') | IL-6[1] | TNF-α[1] | IFN-γ[1] | GM-CSF | IL-12 |
|---|---|---|---|---|---|---|
| 512 SEQ ID NO: 22 | TCCATGTCGGTCCTGATGCT | 500 | 140 | 15.6 | 70 | 250 |
| 1637 SEQ ID NO: 43 | ......C............ | 550 | 16 | 7.8 | 15.6 | 35 |
| 1615 SEQ ID NO: 44 | ......G............ | 600 | 145 | 7.8 | 45 | 250 |
| 1645 (SEQ ID NO: 45) | ......A............ | 550 | 31 | 0 | 50 | 250 |
| 1636 SEQ ID No: 46 | ........A.......... | 325 | 250 | 35 | 40 | 0 |
| 1634 SEQ ID No: 47 | ........C.......... | 300 | 400 | 40 | 85 | 200 |
| 1619 SEQ ID No: 48 | ........T.......... | 275 | 450 | 200 | 80 | >500 |
| 1618 SEQ ID No: 24 | ......A..T......... | 300 | 60 | 15.6 | 15.6 | 62 |
| 1639 SEQ ID No: 49 | .....AA..T......... | 625 | 220 | 15.6 | 40 | 60 |
| 1707 SEQ ID No: 50 | ......A..TC........ | 300 | 70 | 17 | 0 | 0 |
| 1708 SEQ ID No: 51 | .....CA..TG........ | 270 | 10 | 17 | 0 | 0 |

TABLE 9

Induction of NK Activity by DNA Containing CpG Motifs but not by Non-CpG DNA

| | DNA or Cytokine Added | LU/10^6 Mouse Cells | LU/10^6 Human cells |
|---|---|---|---|
| Expt. 1 | None | 0.00 | 0.00 |
| | IL-2 | 16.68 | 15.82 |
| | *E. Coli*, DNA | 7.23 | 5.05 |
| | Calf thymus DNA | 0.00 | 0.00 |
| Expt. 2 | None | 0.00 | 3.28 |
| | 1585 ggGGGGTCAACGTTGAGGGGGGgggg (SEQ ID No. 743) | 7.38 | 17.98 |
| | 1629 ----------gtc------------- (SEQ ID No. 744) | 0.00 | 4.4 |

TABLE 9-continued

Induction of NK Activity by DNA Containing CpG Motifs but not by Non-CpG DNA

|  | DNA or Cytokine Added |  | LU/10⁶ Mouse Cells | Human cells |
|---|---|---|---|---|
| Expt. 3 | None |  | 0.00 |  |
| 1613 | GCTAGA<u>CG</u>TTAGTGT | (SEQ ID No. 54) | 5.22 |  |
| 1769 | -------Z----- | (SEQ ID No. 745) | 0.02 | ND |
| 1619 | TCCATGT<u>CG</u>TTCCTGATGCT | (SEQ ID No: 48) | 3.35 |  |
| 1765 | -------Z--------- | (SEQ ID No. 56) | 0.11 |  |

TABLE 10

Different CpG motifs stimulate optimal murine B cell and NK activation

| ODM | Sequence | B cell activation[1] | NK activation[2] |
|---|---|---|---|
| 1668 | TCCATGA<u>CG</u>TTCCTGATGCT (SEQ. ID. NO: 24) | 42,849 | 2.52 |
| 1758 | TCTCCCAG<u>CG</u>TG<u>CG</u>CCAT (SEQ. ID. NO: 59) | 1,747 | 6.66 |
| NONE |  |  |  |

CpG dinucleotides are underlined;
oligonucleotides were synthesized with phosphorothioate modified backbones to improve their nuclease resistance.
[1]Measured by ³H thymidine incorporation after 48 hr culture with oligodeoxynucleotides at a 200 nM concentration as described in Example 1.
[2]Measured in lytic units.

U.S. Pat. No. 6,214,806 B1

TABLE 1

| ODN Number | cells/ml × 10⁴ | PMN/ml × 10⁸ | % PMN |
|---|---|---|---|
| expt 1, C3H/BPe,1 mice | | | |
| 1908 | 61.4 ± 15.9 | 59.2 ± 15.7 | 95.8 ± 0.95 |
| 1760 | 27.8 ± 3.5* | 25.8 ± 3.0* | 93.3 ± 2.3 |
| 1631 | 47.6 ± 11.1 | 46.1 ± 10.7 | 96.8 ± 1.11 |
| 1835 | 43.8 ± 7.1 | 44.4 ± 7.1 | 96.8 ± 0.75 |
| 1759 | 71.0 ± 19.8 | 67.7 ± 20.4 | 96.8 ± 2.6 |
| 1826 | 39.8 ± 7.8 | 38.3 ± 7.9 | 93.5 ± 1.4 |
| None (saline) | 71.0 ± 7.4 | 69.3 ± 6.9 | 97.8 ± 1.3 |
| expt 2, C57 Bl/6 mice | | | |
| 1908 | 18.0 ± 2.6 | 16.6 ± 2.7 | 91.2 ± 3.7 |
| 1760 | 10.2 ± 2.3* | 8.6 ± 2.1* | 82.0 ± 3.0 |
| 1585 | 11.0 ± 2.2* | 9.5 ± 2.2* | 84.6 ± 2.9 |
| 2010 | 14.1 ± 2.1 | 11.8 ± 1.9 | 83.4 ± 2.1 |
| None (saline) | 17.9 ± 3.4 | 16.9 ± 2.1 |  |
| expt 3 | | | |
| 1908 | 19.0 ± 2.5 | 16.9 ± 2.1 | 89.4 ± 1.4 |
| 1760 | 9.1 ± 0.8* | 7.7 ± 0.7* | 84.6 ± 0.5 |

TABLE 1-continued

| ODN Number | cells/ml × 10⁴ | PMN/ml × 10⁸ | % PMN |
|---|---|---|---|
| 1972 | 15.3 ± 1.6 | 13.5 ± 1.4 | 84.2 ± 1.2 |
| 2001 | 13.0 ± 1.6* | 11.8 ± 1.6 | 90.4 ± 2.2 |

*P > 0.05, Mean Whitney U test

TABLE 2

Induction Of NK Activity By CpG Oligodeoxynucleotides (ODN)

| | % YAC-1 Specific Lysis* Effector:Target | | % 2C11 Specific Lysis Effector:Target | |
|---|---|---|---|---|
| ODN | 50:1 | 100:1 | 50:1 | 100:1 |
| None | −1.1 | −1.4 | 15.3 | 16.6 |
| 1 | 16.1 | 24.5 | 38.7 | 47.2 |
| 3Dd | 17.1 | 27.0 | 37.0 | 40.0 |
| non-CpG ODN | −1.6 | −1.7 | 14.8 | 15.4 |

TABLE 3

Induction of NK Activity by DNA Containing CpG Motifs but not by Non-CpG DNA

|  | DNA or Cytokine Added | | LU/10⁵ Mouse Cells | LU/10⁵ Human Cells |
|---|---|---|---|---|
| Expt. 1 | None | | 0.00 | 0.00 |
|  | IL-2 | | 16.68 | 15.82 |
|  | *E. Coli* DNA | | 7.23 | 5.05 |
|  | Calf thymus DNA | | 0.00 | 0.00 |
| Expt. 2 | None | | 0.00 | 3.28 |
|  | 1585 ggGGTCAA<u>CG</u>TTGACgggg | (SEQ ID NO: 46) | 7.38 | 17.98 |
|  | 1629 --------gtc-------- | (SEQ ID NO: 47) | 0.00 | 4.4 |
| Expt. 3 | None | | 0.00 | |
|  | 1613 GCTAGA<u>CG</u>TTAGTGT | (SEQ ID NO: 54) | 5.22 | |
|  | 1769 -------X----- | (SEQ ID NO: 45) | 0.02 | ND |
|  | 1619 TCCATGT<u>CG</u>TTCCTGATGCT | (SEQ ID NO: 48) | 3.35 | |
|  | 1765 --------X----------- | (SEQ ID NO: 748) | 0.11 | |

CpG dinucleotides in ODN sequences are indicated by underlining;
X indicates methylcytosine.
Lower case letters indicate nuclease resistant phosphorothioate modified internucleotide linkages which, in titration experiments, were more than 20 times as potent as non-modified ODN, depending on the flanking bases.
Poly G ends (g) were used in some ODN, because they significantly increase the level of ODN uptake.
Dashes indicate some bases are identical to those in the directly preceding sequence, with the exception of changes noted.

TABLE 4

ODN induction of NK Lytic Activity (LU)

| ODN | Sequence (5'-3') | | LU |
|---|---|---|---|
| None | | | |
| 1754 | ACCATGGACGATCTGTTTCCCCCTC | (SEQ ID NO: 58) | 0.02 |
| 1758 | TCTCCCAGCGTGCGCCAT | (SEQ ID NO: 59) | 0.05 |
| 1761 | TACCGCGTGCGACCCTCT | (SEQ ID NO: 60) | 0.05 |
| 1776 | ACCATGGACGAACTGTTTCCCCTC | (SEQ ID NO: 61) | 0.03 |
| 1777 | ACCATGGACGAGCTGTTTCCCCTC | (SEQ ID NO: 62) | 0.05 |
| 1778 | ACCATGGACGACCTGTTTCCCCTC | (SEQ ID NO: 63) | 0.01 |
| 1779 | ACCATGGACGTACTGTTTCCCCTC | (SEQ ID NO: 64) | 0.02 |
| 1780 | ACCATGGACGGTCTGTTTCCCCTC | (SEQ ID NO: 65) | 0.29 |
| 1781 | ACCATGGACGTTCTGTTTCCCCTC | (SEQ ID NO: 66) | 0.38 |
| 1823 | GCATGACGTTGAGCT | (SEQ ID NO: 41) | 0.08 |
| 1824 | CACGTTGAGGGGCAT | (SEQ ID NO: 67) | 0.01 |
| 1825 | CTGCTGAGACTGGAG | (SEQ ID NO: 68) | 0.01 |
| 1828 | TCAGCGTGCGCC | (SEQ ID NO: 69) | 0.01 |
| 1829 | ATGACGTTCCTGACGTT | (SEQ ID NO: 70) | 0.42 |
| 1830₂ | RANDOM SEQUENCE | | 0.25 |
| 1834 | TCTCCCAGCGGGCGCAT | (SEQ ID NO: 71) | 0.00 |
| 1836 | TCTCCCAGCGCGCGCCAT | (SEQ ID NO: 72) | 0.46 |
| 1840 | TCCATGTCGTTCCTGTCGTT | (SEQ ID NO: 73) | 2.70 |
| 1841 | TCCATAGCGTTCCTAGCGTT | (SEQ ID NO: 74) | 1.45 |
| 1842 | TCGTCGCTGTCTCCGCTTCTT | (SEQ ID NO: 75) | 0.06 |
| 1851 | TCCTGACGTTCCTGACGTT | (SEQ ID NO: 76) | 2.32 |

₁Lytic units (LU) were measured as described (8). Briefly, PBMC were collected from normal donors and spun over Ficoll, then cultured with or without the indicated ODN (which were added to cultures at 6 µg/ml) for 24 hr. Then their ability to lyse |Cr-labeled K562 cells was determined. The results shown are typical of those obtained with several different normal human donors.

₂This oligo mixture contained a random selection of all 4 bases at each position.

TABLE 5

Induction of NK LU by Phoshorothioate CpG ODN with Good Motifs

| ODN[1] | sequence (5'-3') | | expt. 1 | expt. 2 | expt. 3 |
|---|---|---|---|---|---|
| None | | | 0.00 | 1.26 | 0.46 |
| 1840 | TCCATGTCGTTCCTGTCGTT | (SEQ ID NO: 73) | 2.33 | ND | ND |
| 1960 | TCCTGTCGTTCCTGTCGTT | (SEQ ID NO: 77) | ND | 0.48 | 8.99 |
| 1961 | TCCATGTCGTTTTTGTCGTT | (SEQ ID NO: 78) | 4.03 | 1.23 | 5.08 |
| 1962 | TCCTGTCGTTCCTTGTCGTT | (SEQ ID NO: 79) | ND | 1.60 | 5.74 |
| 1963 | TCCTTGTCGTTCCTGTCGTT | (SEQ ID NO: 80) | 3.42 | ND | ND |
| 1965 | TCCTGTCGTTTTTTGTCGTT | (SEQ ID NO: 81) | 0.46 | 0.42 | 3.48 |
| 1966 | TCGTCGCTGTCTCCGCTTCTT | (SEQ ID NO: 75) | 2.62 | ND | ND |
| 1967 | TCGTCGCTGTCTGCCCTTCTT | (SEQ ID NO: 82) | 5.82 | 1.64 | 8.32 |
| 1968 | TCGTCGCTGTTGTCGTTTCTT | (SEQ ID NO: 83) | 3.77 | 5.26 | 6.12 |
| 1979[2] | TCCATGTZGTTCCTGTZGTT | (SEQ ID NO: 84) | 1.32 | ND | ND |
| 1982 | TCCAGGACTTCTCTCAGGTT | (SEQ ID NO: 85) | 0.05 | ND | 0.98 |
| 1990 | TCCATGCGTGCGTGCGTTTT | (SEQ ID NO: 86) | 2.10 | ND | ND |
| 1991 | TCCATGCGTTGCGTTGCGTT | (SEQ ID NO: 87) | 0.89 | ND | ND |
| 2002 | TCCACGACGTTTTCGACGTT | (SEQ ID NO: 88) | 4.02 | 1.31 | 9.79 |
| 2005 | TCGTCGTTGTCGTTGTCGTT | (SEQ ID NO: 89) | ND | 4.22 | 12.75 |
| 2006 | TCGTCGTTTTGTCGTTTTGTCGTT | (SEQ ID NO: 90) | ND | 6.17 | 12.82 |
| 2007 | TCGTCGTTGTCGTTTTGTCGTT | (SEQ ID NO: 91) | ND | 2.68 | 9.66 |
| 2008 | GCGTGCGTTGTCGTTGTCGTT | (SEQ ID NO: 92) | ND | 1.37 | 8.15 |
| 2010 | GCGGCGGGCGGCGCGCGCCC | (SEQ ID NO: 93) | ND | 0.01 | 0.05 |
| 2012 | TGTCGTTTGTCGTTTGTCGTT | (SEQ ID NO: 94) | ND | 2.02 | 11.61 |
| 2013 | TGTCGTTGTCGTTGTCGTTGTCGTT | (SEQ ID NO: 95) | ND | 0.56 | 5.22 |
| 2014 | TGTCGTTGTCGTTGTCGTT | (SEQ ID NO: 96) | ND | 5.74 | 10.89 |
| 2015 | TCGTCGTCGTCGTT | (SEQ ID NO: 97) | ND | 4.53 | 10.13 |
| 2016 | TGTCGTTGTCGTT | (SEQ ID NO: 98) | ND | 6.54 | 8.06 |

[1]PBMC essentially as described herein. Results are representative of 6 separate experiments; each experiment represents a different donor.
[2]This is the methylated version of ODN 1840; Z = 5-methyl cytosine LU is lytic units; ND = not done; CpG dinucleotides are underlined for clarity.

TABLE 6

Induction of human B cell proliferation by Phoshorothioate CpG ODN

| | | | Stimulation Index[1] | | | | | |
|---|---|---|---|---|---|---|---|---|
| DB | sequence (5'-3') | | expt. 1 | expt. 2 | expt. 3 | expt. 4 | expt. 5 | expt. 6 |
| 1840 | TCCATGTCGTTCCTGTCGTT | (SEQ ID NO: 84) | 4 | ND | ND | ND | ND | 34 |
| 1841 | TCCATAGCGTTCCTAGCGTT | (SEQ ID NO: 99) | 3 | ND | ND | ND | ND | ND |
| 1960 | TCCTGTCGTTCCTGTCGTT | (SEQ ID NO: 77) | ND | 2.0 | 2.0 | 3.6 | ND | ND |
| 1961 | TCCATGTCGTTTTTGTCGTT | (SEQ ID NO: 78) | 2 | 3.9 | 1.9 | 3.7 | ND | 37 |
| 1962 | TCCTGTCGTTCCTTGTCGTT | (SEQ ID NO: 79) | ND | 3.8 | 1.9 | 3.9 | 5.4 | 35 |
| 1963 | TCCTTGTCGTTCCTGTCGTT | (SEQ ID NO: 80) | 3 | ND | ND | ND | ND | ND |
| 1965 | TCCTGTCGTTTTTTGTCGTT | (SEQ ID NO: 81) | 4 | 3.7 | 2.4 | 4.7 | 6.0 | 43 |

TABLE 6-continued

Induction of human B cell proliferation by Phosphorothioate CpG ODN

| DB sequence (5'-3') | | Stimulation Index[1] | | | | | |
|---|---|---|---|---|---|---|---|
| | | expt. 1 | expt. 2 | expt. 3 | expt. 4 | expt. 5 | expt. 6 |
| 1967 TCGTCGCTGTCTGCCCTTCTT | (SEQ ID NO: 82) | ND | 4.4 | 2.0 | 4.5 | 5.0 | 36 |
| 1968 TCGTCGCTGTTGTCGTTTCTT | (SEQ ID NO: 83) | ND | 4.0 | 2.0 | 4.9 | 8.7 | 38 |
| 1982 TCCAGGACTTCTCTCAGGTT | (SEQ ID NO: 85) | 3 | 1.8 | 1.3 | 3.1 | 3.2 | 12 |
| 2002 TCCACGACGTTTTCGACGTT | (SEQ ID NO: 88) | ND | 2.7 | 1.4 | 4.4 | ND | 14 |
| 2005 TCGTCGTTGTCGTTGTCGTT | (SEQ ID NO: 89) | 5 | 3.2 | 1.2 | 3.0 | 7.9 | 37 |
| 2006 TCGTCGTTTTGTCGTTTTGTCGTT | (SEQ ID NO: 90) | 4 | 4.5 | 2.2 | 5.8 | 8.3 | 40 |
| 2007 TCGTCGTTGTCGTTTTGTCGTT | (SEQ ID NO: 91) | 3 | 4.0 | 4.2 | 4.1 | ND | 22 |
| 2008 GCGTGCGTTGTCGTTGTCGTT | (SEQ ID NO: 92) | ND | 3.0 | 2.4 | 1.6 | ND | 12 |
| 2010 GCGGCGGGCGGCGCGCGCCC | (SEQ ID NO: 93) | ND | 1.6 | 1.9 | 3.2 | ND | ND |
| 2012 TGTCGTTTGTCGTTTGTCGTT | (SEQ ID NO: 94) | 2 | 2.8 | 0 | 3.2 | ND | 33 |
| 2013 TGTCGTTGTCGTTGTCGTTGTCGTT | (SEQ ID NO: 95) | 3 | 2.3 | 3.1 | 2.8 | ND | 7 |
| 2014 TGTCGTTGTCGTTGTCGTT | (SEQ ID NO: 96) | 3 | 2.5 | 4.0 | 3.2 | 6.7 | 14 |
| 2015 TCGTCGTCGTCGTT | (SEQ ID NO: 97) | 5 | 1.8 | 2.6 | 4.5 | 9.4 | 1 |
| 2016 TGTCGTTGTCGTT | (SEQ ID NO: 98) | ND | 1.1 | 1.7 | 2.7 | 7.3 | 1 |

[1]Cells = human spleen cells stored at −70° C. after surgical harvest or PBNC collected from normal donors and spon over Eicoll. Cells were cultured in 96 well U-bottom microtiter plates with or without the indicated ODN (which were added to cultures at 6 µml). N = 12 experiments. Cells were cultured for 4-7 days, pulsed with 1 µCl of $^3$H thymidine for 18 hr before harvest and scintillation counting. Stimulation index = the ratio of cpm in wells without ODN to that in wells that had been stimulated throughout the culture period with the indicated ODN (there were no further additions of ODN after the cultures were set up).
ND = not done

TABLE 7

Induction of human IL-12 secretion by Phosphorothioate CpG ODN

| ODN[1] sequence (5'-3') | | IL-12 (pg/ml) | |
|---|---|---|---|
| | | expt. 1 | expt. 2 |
| None | | 0 | 0 |
| 1962 TCCTGTCGTTCCTTGTCGTT | (SEQ ID NO: 79) | 19 | 0 |
| 1965 TCCTGTCGTTTTTTGTCGTT | (SEQ ID NO: 81) | 36 | 0 |
| 1967 TCGTCGCTGTCTGCCCTTCTT | (SEQ ID NO: 82) | 41 | 0 |
| 1968 TCGTCGCTGTTGTCGTTTCTT | (SEQ ID NO: 83) | 24 | 0 |
| 2005 TCGTCGTTGTCGTTGTCGTT | (SEQ ID NO: 89) | 25 | 0 |
| 2006 TCGTCGTTTTGTCGTTTTGTCGTT | (SEQ ID NO: 90) | 29 | 15 |
| 2014 TGTCGTTGTCGTTGTCGTT | (SEQ ID NO: 96) | 28 | 0 |
| 2015 TCGTCGTCGTCGTT | (SEQ ID NO: 97) | 14 | 0 |
| 2016 TGTCGTTGTCGTT | (SEQ ID NO: 98) | 3 | 0 |

[1]PBMC were collected from normal donors and spun over Ficoll, then cultured at 10$^6$ cells/well in 96 well microtiter plates with or without the indicated ODN which were added to cultures at 6 µg/ml. Supernatants were collected at 24 hr and tested for IL-12 levels by ELISA as described in methods. A standard curve was run in each experiment, which represents a different donor.

TABLE 8

Different CpG motifs stimulate optimal murine B cell and NK activation

| ODN Sequence | | B cell activation[1] | NK activation[2] |
|---|---|---|---|
| 1668 | TCCATGA<u>CG</u>TTCCTGATGCT (SEQ ID NO: 24) | 42,849 | 2.52 |
| 1758 | TCTCCCAG<u>CG</u>TG<u>CG</u>CCAT (SEQ ID NO: 59) | 1,747 | 6.66 |
| NONE | | | |

CpG dinucleotides are underlined;
oligonucleotides were synthesized with phosphorothioate modified backbones to improve their nuclease resistance.
[1]Measured by $^3$H thymidine incorporation after 48 hr culture with oligodeoxy-nucleotides at a 200 nM concentration as described in Example 1.
[2]Measured in lytic units.

U.S. Pat. No. 6,218,371

TABLE 1

| sequences | |
|---|---|
| GCTAGA<u>CG</u>TTAG<u>CG</u>T | (SEQ ID NO: 1) |
| GCTAGATGTTAG<u>CG</u>T | (SEQ ID NO: 2) |
| GCTAGAZGTTAG<u>CG</u>T | (SEQ ID NO: 3) |
| GCTAGA<u>CG</u>TTAGZGT | (SEQ ID NO: 4) |
| GCATGA<u>CG</u>TTGAG<u>CT</u> | (SEQ ID NO: 5) |
| ATGGAAGGTCCAG<u>CG</u>TTCTC | (SEQ ID NO: 6) |
| AT<u>CG</u>ACTCT<u>CG</u>AG<u>CG</u>TTCTC | (SEQ ID NO: 7) |
| ATZGACTCTZGAGZGTTCTC | (SEQ ID NO: 8) |
| ATZGACTCT<u>CG</u>AG<u>CG</u>TTCTC | (SEQ ID NO: 9) |
| AT<u>CG</u>ACTCT<u>CG</u>AG<u>CG</u>TTZTC | (SEQ ID NO: 10) |
| AT<u>CG</u>ACTCT<u>CG</u>AA<u>CG</u>TTCTC | (SEQ ID NO: 11) |
| GAGAA<u>CG</u>CTGGACCTTCCAT | (SEQ ID NO: 12) |
| GAGAA<u>CG</u>CT<u>CG</u>ACCTTCCAT | (SEQ ID NO: 13) |
| GAGAA<u>CG</u>CT<u>CG</u>ACCTT<u>CG</u>AT | (SEQ ID NO: 14) |
| GAGCA<u>AG</u>CTGGACCTTCCAT | (SEQ ID NO: 15) |
| GAGCAZ<u>G</u>CTGGACCTTCCAT | (SEQ ID NO: 16) |
| GAGAA<u>CG</u>CTGGAC<u>ZT</u>TCCAT | (SEQ ID NO: 17) |
| GAGAA<u>CG</u>ATGGACCTTCCAT | (SEQ ID NO: 18) |
| TCCATGTZGTTCCTGATGCT | (SEQ ID NO: 57) |
| ACCATGGACGATCTGTTTCCCCTC | (SEQ ID NO: 58) |
| TCTCCCAGCGTGCGCCAT | (SEQ ID NO: 59) |
| TACCGCGTGCGACCCTCT | (SEQ ID NO: 60) |
| ACCATGGACGAACTGTTTCCCCTC | (SEQ ID NO: 61) |
| ACCATGGACGAGCTGTTTCCCCTC | (SEQ ID NO: 62) |
| ACCATGGACGACCTGTTTCCCCTC | (SEQ ID NO: 63) |
| ACCATGGACGTACTGTTTCCCCTC | (SEQ ID NO: 64) |
| ACCATGGACGGTCTGTTTCCCCTC | (SEQ ID NO: 65) |
| ACCATGGACGTTCTGTTTCCCCTC | (SEQ ID NO: 66) |

TABLE 1-continued

| sequences | |
|---|---|
| CACGTTGAGGGGCAT | (SEQ ID NO: 67) |
| CTGCTGAGACTGGAG | (SEQ ID NO: 68) |
| TCAGCGTGCGCC | (SEQ ID NO: 69) |
| ATGACGTTCCTGACGTT | (SEQ ID NO: 70) |
| TCTCCCAGCGGGCGCAT | (SEQ ID NO: 71) |
| TCTCCCAGCGCGCGCCAT | (SEQ ID NO: 72) |
| TCCATGTCGTTCCTGTCGTT | (SEQ ID NO: 73) |
| TCCATAGCGTTCCTAGCGTT | (SEQ ID NO: 74) |
| TCGTCGCTGTCTCCGCTTCTT | (SEQ ID NO: 75) |
| TCCTGACGTTCCTGACGTT | (SEQ ID NO: 76) |
| TCCTGT<u>CG</u>TTCCTGT<u>CG</u>TT | (SEQ ID NO: 77) |
| TCCATGT<u>CG</u>TTTTTGT<u>CG</u>TT | (SEQ ID NO: 78) |
| TCCTGT<u>CG</u>TTCCTTGT<u>CG</u>TT | (SEQ ID NO: 79) |
| TCCTTGT<u>CG</u>TTCCTGT<u>CG</u>TT | (SEQ ID NO: 80) |
| TCCTGT<u>CG</u>TTTTTGT<u>CG</u>TT | (SEQ ID NO: 81) |
| T<u>CG</u>T<u>CG</u>CTGTCTGCCCTTCTT | (SEQ ID NO: 82) |
| T<u>CG</u>T<u>CG</u>CTGTTGT<u>CG</u>TTTCTT | (SEQ ID NO: 83) |
| TCCATGTZGTTCCTGTZGTT | (SEQ ID NO: 84) |
| TCCAGGACTTCTCTCAGGTT | (SEQ ID NO: 85) |
| TCCATG<u>CG</u>TG<u>CG</u>TG<u>CG</u>TTTT | (SEQ ID NO: 86) |
| TCCATG<u>CG</u>TTG<u>CG</u>TTG<u>CG</u>TT | (SEQ ID NO: 87) |
| TCCA<u>CG</u>A<u>CG</u>TTTT<u>CG</u>A<u>CG</u>TT | (SEQ ID NO: 88) |
| T<u>CG</u>T<u>CG</u>TTGT<u>CG</u>TTGT<u>CG</u>TT | (SEQ ID NO: 89) |
| T<u>CG</u>T<u>CG</u>TTTTGT<u>CG</u>TTTTGT<u>CG</u>TT | (SEQ ID NO: 90) |
| T<u>CG</u>T<u>CG</u>TTGT<u>CG</u>TTTTGT<u>CG</u>TT | (SEQ ID NO: 91) |
| G<u>CG</u>TG<u>CG</u>TTGT<u>CG</u>TTGT<u>CG</u>TT | (SEQ ID NO: 92) |
| G<u>CG</u>G<u>CG</u>GG<u>CG</u>G<u>CGCGCG</u>CCC | (SEQ ID NO: 93) |
| TGT<u>CG</u>TTTGT<u>CG</u>TTTGT<u>CG</u>TT | (SEQ ID NO: 94) |

TABLE 1-continued sequences

| | |
|---|---|
| TGTCGTTGTCGTTGTCGTTGTCGTT | (SEQ ID NO: 95) |
| TGTCGTTGTCGTTGTCGTT | (SEQ ID NO: 96) |
| TCGTCGTCGTCGTT | (SEQ ID NO: 97) |
| TGTCGTTGTCGTT | (SEQ ID NO: 98) |
| TCCATAGCGTTCCTAGCGTT | (SEQ ID NO: 99) |
| TCCATGACGTTCCTGACGTT | (SEQ ID NO: 100) |
| GTCG(T/C)T | (SEQ ID NO: 101) |
| TGTCG(T/C)T | (SEQ ID NO: 102) |
| TCCATGAGCTTCCTGAGTCT | (SEQ ID NO: 103) |
| TCTCCCAGCGTGCGCCAT | (SEQ ID NO: 104) |
| TCCATGACGTTCCTGACGTT | (SEQ ID NO: 105) |

TABLE 2

Induction of human IL-12 secretion by Phosphorothioate CpG oligonucleotide

| | | | IL-12 (pg/ml) | |
|---|---|---|---|---|
| ODN[1] sequence (5'-3') | | | expt. 1 | expt. 2 |
| None | | | 0 | 0 |
| 1962 TCCTGTCGTTCCTTGTCGTT | (SEQ. ID NO: 79) | | 19 | 0 |
| 1965 TCCTGTCGTTTTTGTCGTT | (SEQ. ID NO: 81) | | 36 | 0 |
| 1967 TCGTCGCTGTCTGCCCTTCTT | (SEQ. ID NO: 82) | | 41 | 0 |
| 1968 TCGTCGCTGTTGTCGTTTCTT | (SEQ. ID NO: 83) | | 24 | 0 |
| 2005 TCGTCGTTGTCGTTGTCGTT | (SEQ. ID NO: 89) | | 25 | 0 |
| 2006 TCGTCGTTTTGTCGTTTTGTCGTT | (SEQ ID NO: 90) | | 29 | 15 |
| 2014 TGTCGTTGTCGTTGTCGTT | (SEQ. ID NO: 96) | | 28 | 0 |
| 2015 TCGTCGTCGTCGTT | (SEQ. ID NO: 97) | | 14 | 0 |
| 2016 TGTCGTTGTCGTT | (SEQ. ID NO: 98) | | 3 | 0 |

[1]PBMC were collected from normal donors and spun over Ficoll, then cultured at $10^6$ cells/well in 96 well microtiter plates with or without the indicated oligonucleotide which were added to cultures at μg/ml. Supernatants were collected at 24 hr and tested for IL-12 levels by ELISA as described in methods. A standard curve was run in each experiment, which represents a different donor.

TABLE 3

| Compound | CD86 (5 Exp) | CD40 (4 Exp.) | T cell proliferation |
|---|---|---|---|
| GM-CSF | 1.9 | 2.5 | 13.3 |
| CpG | 3.9 | 3.5 | 19.7 |
| CpG + GM-CSF | 7.0 | 8.5 | 25.6 |

U.S. Pat. No. 6,239,116 B1

TABLE 1

Olionucleotide Stimulation of Mouse B Cells

| ODN | Sequence (5' to 3')† | Stimulation Index[1] $^3$H Uridine | IgM Production |
|---|---|---|---|
| 1   (SEQ ID NO: 41) | GCTAGACGTTAGCGT | 6.1 ± 0.8 | 17.9 ± 3.6 |
| 1a  (SEQ. ID NO: 42) | ......T........ | 1.2 ± 0.2 | 1.7 ± 0.5 |
| 1b  (SEQ ID NO: 3) | ......Z........ | 1.2 ± 0.1 | 1.8 ± 0.0 |
| 1c  (SEQ ID NO: 4) | ............Z.. | 10.3 ± 4.4 | 9.5 ± 1.8 |
| 1d  (SEQ ID NO: 5) | ..AT......GAGC. | 13.0 ± 2.3 | 18.3 ± 7.5 |
| 2   (SEQ ID NO: 6) | ATGGAAGGTCCAGCGTTCTC | 2.9 ± 0.2 | 13.6 ± 2.0 |
| 2a  (SEQ ID NO: 7) | ..C..CTC..G........ | 7.7 ± 0.8 | 24.2 ± 3.2 |
| 2b  (SEQ ID NO: 8) | ..Z..CTC.ZG..Z..... | 1.6 ± 0.5 | 2.8 ± 2.2 |
| 2c  (SEQ ID NO: 9) | ..Z..CTC..G........ | 3.1 ± 0.6 | 7.3 ± 1.4 |
| 2d  (SEQ ID NO: 10) | ..C..CTC..G......Z.. | 7.4 ± 1.4 | 27.7 ± 5.4 |
| 2e  (SEQ ID NO: 740) | ............A...... | 5.6 ± 2.0 | ND |
| 3D  (SEQ ID NO: 12) | GAGAACGCTGGACCTTCCAT | 4.9 ± 0.5 | 19.9 ± 3.6 |
| 3Da (SEQ ID NO: 749) | .......C.......... | 6.6 ± 1.5 | 33.9 ± 6.8 |
| 3Db (SEQ ID NO: 14) | ........C......G.. | 10.1 ± 2.8 | 25.4 ± 0.8 |
| 3Dc (SEQ ID NO: 15) | ...C.A............ | 1.0 ± 0.1 | 1.2 ± 0.5 |
| 3Dd (SEQ ID NO: 17) | .....Z............ | 1.2 ± 0.2 | 1.0 ± 0.4 |
| 3De (SEQ ID NO: 12) | ...........Z...... | 4.4 ± 1.2 | 18.8 ± 4.4 |
| 3Df (SEQ ID NO: 18) | ......A........... | 1.6 ± 0.1 | 7.7 ± 0.4 |
| 3Dg (SEQ ID NO: 19) | ........CC.G.ACTG.. | 6.1 ± 1.5 | 18.6 ± 1.5 |
| 3M  (SEQ ID NO: 22) | TCCATGTCGGTCCTGATGCT | 4.1 ± 0.2 | 23.2 ± 4.9 |
| 3Ma (SEQ ID NO: 21) | ......CT.......... | 0.9 ± 0.1 | 1.8 ± 0.5 |
| 3Mb (SEQ ID NO: 22) | .......Z.......... | 1.3 ± 0.3 | 1.5 ± 0.6 |
| 3Mc (SEQ ID NO: 23) | ........Z.......... | 5.4 ± 1.5 | 8.5 ± 2.6 |
| 3Md (SEQ ID NO: 24) | ......A..T........ | 17.2 ± 9.4 | ND |
| 3Me (SEQ ID NO: 741) | ..............C..A. | 3.6 ± 0.2 | 14.2 ± 5.2 |
| 4   (SEQ ID NO: 26) | TCAACGTT | 6.1 ± 1.4 | 19.2 ± 5.2 |
| 4a  (SEQ ID NO: 27) | ....GC.. | 1.1 ± 0.2 | 1.5 ± 1.1 |
| 4b  (SEQ ID NO: 28) | ...GCGC. | 4.5 ± 0.2 | 9.6 ± 3.4 |
| 4c  (SEQ ID NO: 2306) | ...TCGA. | 2.7 ± 1.0 | ND |
| 4d  (SEQ ID NO: 30) | ..TT..AA | 1.3 ± 0.2 | ND |
| 4e  (Residue 2-8 of SEQ ID NO: 26) (SEQ ID NO: 31) | -....... | 1.3 ± 0.2 | 1.1 ± 0.5 |

TABLE 1-continued

Olionucleotide Stimulation of Mouse B Cells

| | | Stimulation Index[1] | |
|---|---|---|---|
| ODN | Sequence (5' to 3')† | ³H Uridine | IgM Production |
| 4f (SEQ ID NO: 32) | C.......  | 3.9 ± 1.4 | ND |
| 4g (Residue 11-18 of SEQ ID NO: 740) (SEQ ID NO: 2307) | --......CT | 1.4 ± 0.3 | ND |
| 4h (SEQ ID NO: 34) | .......C | 1.2 ± 0.2 | ND |
| LPS | | 7.8 ± 2.5 | 4.8 ± 1.0 |

[1]Stimulation indexes are the means and std. dev. derived from at least 3 separate experiments, and are compared to wells cultured with no added ODN.

ND = not done.

CpG dinuclectides are underlined.

Dots indicate identity; dashes indicate deletions.

Z indicates 5 methyl cytosine.

TABLE 2

Identification of the optimal CpG motif for Murine IL-6 production and B cell activation

| ODN SEQUENCE (5'-3') | | IL-6 (pg/ml)[a] CH12.LX | SPLENIC B CELL | SI[b] | IgM (ng/ml)[c] |
|---|---|---|---|---|---|
| 512 (SEQ ID NO: 22) | TCCATGTCGTCCTGATGCT | 1300 ± 106 | 627 ± 43 | 5.8 ± 0.3 | 7315 ± 1324 |
| 1637 (SEQ ID NO: 43) | ......C........... | 136 ± 27 | 46 ± 6 | 1.7 ± 0.2 | 770 ± 72 |
| 1615 (SEQ ID NO: 44) | ......G........... | 1201 ± 155 | 850 ± 202 | 3.7 ± 0.3 | 3212 ± 617 |
| 1614 (SEQ ID NO: 45) | ......A........... | 1533 ± 321 | 1812 ± 103 | 10.8 ± 0.6 | 7558 ± 414 |
| 1636 (SEQ ID NO: 46) | ........A......... | 1181 ± 76 | 947 ± 132 | 5.4 ± 0.4 | 3983 ± 485 |
| 1634 (SEQ ID NO: 47) | ........C......... | 1049 ± 223 | 1671 ± 175 | 9.2 ± 0.9 | 6256 ± 261 |
| 1619 (SEQ ID NO: 48) | ........T......... | 1555 ± 304 | 2908 ± 129 | 12.5 ± 1.0 | 8243 ± 698 |
| 1618 (SEQ ID NO: 24) | ......A..T........ | 2109 ± 291 | 2596 ± 166 | 12.9 ± 0.7 | 10425 ± 674 |
| 1639 (SEQ ID NO: 49) | .....AA..T........ | 1827 ± 83 | 2012 ± 132 | 11.5 ± 0.4 | 9489 ± 103 |
| 1707 (SEQ ID NO: 50) | ......A..TC....... | ND | 1147 ± 175 | 4.0 ± 0.2 | 3534 ± 217 |
| 1708 (SEQ ID NO: 51) | .....CA..TG....... | ND | 59 ± 3 | 1.5 ± 0.1 | 466 ± 109 |

Dots indicate identity;

CpG dinucleotides are underlined;

ND = not done

[a]The experiment was done at least three times with similar results. The level of IL-6 of unstimulated control cultures of both CH12.LX and splenic B cells was ≤10 pg/ml. The IgM level of unstimulated culture was 547 ± 82 ng/ml. CpG dinucleotides are underlined and dots indicate identity.

[b][³H] Uridine uptake was indicated as a fold increase (SI: stimulation index) from unstimulated control (2322.67 ± 213.68 cpm). Cells were stimulated with 20 μM of various CpG O-ODN. Data present the mean ± SD of triplicates

[c]Measured by ELISA.

TABLE 3

Induction of Murine IL-6 secretion by CpG motifs in bacterial DNA or oligonucleotides.

| Treatment | IL-6 (pg/ml) |
|---|---|
| calf thymus DNA | ≤10 |
| calf thymus DNA + DNase | ≤10 |
| E. coli DNA | 1169.5 ± 94.1 |
| E. coli DNA + DNase | ≤10 |
| CpG methylated E. coli DNA | ≤10 |
| LPS | 280.1 ± 17.1 |
| Media (no DNA) | ≤10 |

| ODN | | | |
|---|---|---|---|
| 5a | SEQ. ID. No: 35 | ATGGACTCTCCAGCGTTCTC | 1096.4 ± 372.0 |
| 5b | SEQ. ID. No: 740 | .....AGG....A........ | 1124.5 ± 126.2 |
| 5c | SEQ. ID. No: 7 | ..C......G.......... | 1783.0 ± 189.5 |
| 5d | SEQ. ID. No: 742 | ....AGG..C..T...... | ≤10 |
| 5e | SEQ. ID. No: 2308 | ..C......G...Z...... | 851.1 ± 114.4 |
| 5f | SEQ. ID. No: 99 | ..Z......ZG..Z...... | ≤10 |
| 5g | SEQ. ID. No: 10 | ..C......G.......Z.. | 1862.3 ± 87.26 |

T cell depleted spleen cells from DBA/2 mice were stimulated with phosphodiester modified oligonucleotides (O-ODN) (20 µM), calf thymus DNA (50 µg/ml) or E. Coli DNA (50 µg/ml) with ot without enzyme treatment, or LPS (10 µg/ml) for 24 hr. Data represent the mean (pg/ml) ± SD of triplicates. CpG dinucleotides are underlined and dots indicate identity. Z indicates 5-methylcytosine.

TABLE 4

Secretion of Murine IL-6 induced by CpG DNA stimulation in vivo.

| Stimulant | IL-6 (pg/ml) |
|---|---|
| PBS | <50 |
| E. coli DNA | 13858 ± 3143 |
| Calf Thymus DNA | <50 |
| CpG S-ODN | 20715 ± 606 |
| non-CpG S-ODN | <50 |

Mice (2 mice/group) were i.v. injected with 100 µl of PBS, 200 µg of E. coli DNA or calf. thymus DNA, or 500 µg of CpG S-ODN or non-CpG control S-ODN. Mice were bled 2 hr after injection and 1:10 dilution of each serum was analyzed by IL-6 ELISA. Sensitivity limit of IL-6 ELISA was 5 pg/ml. Sequences of the CpG S-ODN is 5'GCATGACGTTGAGCT3' (SEQ. ID. No: 6) and of the non-stimulatory S-ODN is 5'GCTAGATGTTAGCGT3' (SEQ. ID. No: 49). Note that although there is a CpG in sequence 48, it is too close to the 3' end to effect stimulation, as explained herein. Data represent mean ± SD of duplicates. The experiment was done at least twice with similar results.

TABLE 5

Induction of human PBMC cytokine secrtetion by CpG oligos

| ODN | Sequence (5'-3') | $IL-6_1$ | $TNF-\alpha_1$ | $IFN-\gamma_1$ | GM-CSF | IL-12 |
|---|---|---|---|---|---|---|
| 512 SEQ ID NO: 22 | TCCATGTCGGTCCTGATGCT | 500 | 140 | 15.6 | 70 | 250 |
| 1637 SEQ ID NO: 43 | ......C............. | 550 | 16 | 7.8 | 15.6 | 16 |
| 1615 SEQ ID NO: 44 | ......G............. | 600 | 145 | 7.8 | 45 | 145 |
| 1614 SEQ ID NO: 45 | ......A............. | 550 | 31 | 0 | 50 | 31 |
| 1636 SEQ ID NO: 46 | ........A........... | 325 | 250 | 35 | 40 | 250 |
| 1634 SEQ ID NO: 47 | ........C........... | 300 | 400 | 40 | 85 | 400 |
| 1619 SEQ ID NO: 48 | ........T........... | 275 | 450 | 200 | 80 | 450 |

TABLE 5-continued

Induction of human PBMC cytokine secrtetion by CpG oligos

| ODN | Sequence (5'-3') | IL-6$_1$ | TNF-$\alpha_1$ | IFN-$\gamma_1$ | GM-CSF | IL-12 |
|---|---|---|---|---|---|---|
| 1618 SEQ ID NO: 24 | ......A..T.......... | 300 | 60 | 15.6 | 15.6 | 62 |
| 1639 SEQ ID NO: 49 | .....AA..T.......... | 625 | 220 | 15.6 | 40 | 220 |
| 1707 SEQ ID NO: 50 | ......A..TC......... | 300 | 70 | 17 | 0 | 70 |
| 1708 SEQ ID NO: 51 | .....CA..TG......... | 270 | 10 | 17 | ND | 10 | dots indicate identity; CpG dinucleotides are underlined, measured by ELISA using Quantikine kits from R&D Systems (pg/ml) Cells were caltured in 10% autologous serum with the indicated oligodeoxynucleotides (12 µg/ml) for 4 hr in the case of TNF-α or 24 hr for the other cytokines before supernatant harvest and assay. Data are presented as the level of cytokine above that in wells with no added oligodeoxynucleotide.

TABLE 6

CpG DNA induces cytokine secretion by human PBMC

| DNA | TNF-α(pg/ml)[1] | IL-6 (pg/ml) | IFN-γ (pg/ml) | RANTES (pg/ml) |
|---|---|---|---|---|
| EC DNA (50 µg/ml) | 900 | 12,000 | 700 | 1560 |
| EC DNA (5 µg/ml) | 850 | 11,000 | 400 | 750 |
| EC DNA (0.5 µg/ml) | 500 | ND | 200 | 0 |
| EC DNA (0.05 µg/ml) | 62.5 | 10,000 | 15.6 | 0 |
| EC DNA (50 µg/ml) + L-LME[2] | 0 | ND | ND | ND |
| EC DNA (10 µg/ml) Methyl.[3] | 0 | 5 | ND | ND |
| CT DNA (50 µg/ml) | 0 | 600 | 0 | 0 |

[1]Levels of all cytokines were determined by ELISA using Quantikine kits from R&D Systems as described in the previous table. Results are representative using PBMC from different donors.
[2]Cells were pretreated for 15 min. with L-leucyl-L-leucine methyl ester (M-LME) to determine whether the cytokine production under these conditions was from monocytes (or other L-LME-sensitive cells).
[3]EC DNA was methylated using 2 U/µg DNA of CpG methylase (New England Biolabs) according to the manufacturer's directions, and methylation confirmed by digestion with Hpa-II and Msp-I. As a negative control, samples were included containing twice the maximal amount of LPS contained in the highest concentration of EC DNA which failed to induce detectable cytokine production under these experimental conditions.
ND = not done

TABLE 7

CpG DNA induces cytokine expression in purified human macrophages

| | IL-6 (pg/ml) | GM-CSF (pg/ml) | TNF-α(pg/ml) |
|---|---|---|---|
| Cells alone | 0 | 0 | 0 |
| CT DNA (50 µg/ml) | 0 | 0 | 0 |
| EC DNA (50 µg/ml) | 2000 | 15.6 | 1000 |

TABLE 8

Induction Of NK Activity By CpG Oligodeoxynucleotides (ODN)

| | % YAC-1 Specific Lysis* Effector:Target | | % 2C11 Specific Lysis Effector:Target | |
|---|---|---|---|---|
| ODN | 50:1 | 100:1 | 50:1 | 100:1 |
| None | -1.1 | -1.4 | 15.3 | 16.6 |
| 1 | 16.1 | 24.5 | 38.7 | 47.2 |
| 3Dd | 17.1 | 27.0 | 37.0 | 40.0 |
| non-CpG ODN | -1.6 | -1.7 | 14.8 | 15.4 |

TABLE 9

Induction of NK Activity by DNA Containing CpG Motifs but not by Non-CpG DNA

| | | | LU/10[6] | |
|---|---|---|---|---|
| | DNA or Cytokine Added | | Mouse Cells | Human Cells |
| Expt. 1 | None | | 0.00 | 0.00 |
| | IL-2 | | 16.68 | 15.82 |
| | E. Coli, DNA | | 7.23 | 5.05 |
| | Calf thymus DNA | | 0.00 | 0.00 |
| Expt. 2 | None | | 0.00 | 3.28 |
| | 1585 ggGGTCAACGTTGACgggg | (SEQ ID no. 52) | 7.38 | 17.98 |
| | 1629 ------gtc----- | (SEQ ID no. 50) | 0.00 | 4.4 |
| Expt. 3 | None | | 0.00 | |
| | 1613 GCTAGACGTTAGTGT | (SEQ ID No. 54) | 5.22 | |
| | 1769 ------Z----- | (SEQ ID No. 745) | 0.02 | ND |

TABLE 9-continued

Induction of NK Activity by DNA Containing CpG Motifs but not by Non-CpG DNA

| DNA or Cytokine Added | | LU/10$^6$ Mouse Cells | Human Cells |
|---|---|---|---|
| 1619 TCCATGT<u>CG</u>TTCCTGATGCT | (SEQ ID No: 48) | 3.35 | |
| 1765 -------Z--------- | (SEQ ID No. 56) | 0.11 | |

CpG dinuoleotides in ODN sequences are indicated by underlying; Z indicates methylcytosine. Lower case letters indicate nuclease resistant phosphorothioate modified internucleotide linkagegs which, in titration experiments, were more than 20 times as potent as non-modified ODN, depending on the flanking bases. Poly G ends (g) were used in some ODN, because they significantly inrease the level of ODN uptake.

TABLE 10

ODN induction of NK Lytic Activity (LU)

| ODN cells alone | Sequence (5'-3') | LU 0.01 | |
|---|---|---|---|
| 1754 | ACCATGGACGATCTGTTTCCCCTC | 0.02 | SEQ ID NO: 58 |
| 1758 | TCTCCCAGCGTGCGCCAT | 0.05 | SEQ ID NO: 59 |
| 1761 | TACCGCGTGCGACCCTCT | 0.05 | SEQ ID NO: 60 |
| 1776 | ACCATGGACGAACTGTTTCCCCTC | 0.03 | SEQ ID NO: 61 |
| 1777 | ACCATGGACGAGCTGTTTCCCCTC | 0.05 | SEQ ID NO: 62 |
| 1778 | ACCATGGACGTACTGTTTCCCCTC | 0.01 | SEQ ID NO: 63 |
| 1779 | ACCATGGACGTACTGTTTCCCCTC | 0.02 | SEQ ID NO: 64 |
| 1780 | ACCATGGACGGTCTGTTTCCCCTC | 0.29 | SEQ ID NO: 65 |
| 1781 | ACCATGGACGTTCTGTTTCCCCTC | 0.38 | SEQ ID NO: 66 |
| 1823 | GCATGACGTTGAGCT | 0.08 | SEQ ID NO: 41 |
| 1824 | CACGTTGAGGGGCAT | 0.01 | SEQ ID NO: 67 |
| 1825 | CTGCTGAGACTGGAG | 0.01 | SEQ ID NO: 68 |
| 1828 | TCAGCGTGCGCC | 0.01 | SEQ ID NO: 69 |
| 1829 | ATGACGTTCCTGACGTT | 0.42 | SEQ ID NO: 70 |
| 1830$^2$ | RANDOM SEQUENCE | 0.25 | |
| 1834 | TCTCCCAGCGGGCGCAT | 0.00 | SEQ ID NO: 71 |
| 1836 | TCTCCCAGCGCGCGCCAT | 0.46 | SEQ ID NO: 72 |
| 1840 | TCCATGTCGTTCCTGTCGTT | 2.70 | SEQ ID NO: 73 |
| 1841 | TCCATAGCGTTCCTAGCGTT | 1.45 | SEQ ID NO: 74 |
| 1842 | TCGTCGCTGTCTCCGCTTCTT | 0.06 | SEQ ID NO: 75 |
| 1851 | TCCTGACGTTCCTGACGTT | 2.32 | SEQ ID NO: 76 |

$^1$Lytic unite (LU) were measured as described (8). Briefly, PBMC were collected from normal donors and spun over Ficoll, then cultured with or without the indicated ODN (which were added to cultures at 6 µg/ml) for 24 hr. Then their ability to lyse $^{51}$Cr-labeled K562 cells was determined. The results shown are typical of those obtained with several different normal human donors.
$^2$This oligo mixture contained a random selection of all 4 bases at each position.

TABLE 11

Induction of NK LU by Phoshorothioate CpG ODN with Good Motifs

| ODN$^1$ cells alone | sequence (5'-3') | SEQ ID NO: | expt. 1 0.00 | expt. 2 1.26 | expt. 3 0.46 |
|---|---|---|---|---|---|
| 1840 | TCCATGT<u>CG</u>TTCCTGT<u>CG</u>TT | 73 | 2.33 | ND | ND |
| 1960 | TCCTGT<u>CG</u>TTCCTGT<u>CG</u>TT | 77 | ND | 0.48 | 8.99 |
| 1961 | TCCATGT<u>CG</u>TTTTGT<u>CG</u>TT | 78 | 4.03 | 1.23 | 5.08 |
| 1962 | TCCTGT<u>CG</u>TTCCTTGT<u>CG</u>TT | 79 | ND | 1.60 | 5.74 |
| 1963 | TCCTTGT<u>CG</u>TTCCTGT<u>CG</u>TT | 80 | 3.42 | ND | ND |
| 1965 | TCCTGT<u>CG</u>TTTTTTGT<u>CG</u>TT | 81 | 0.46 | 0.42 | 3.48 |
| 1966 | T<u>CG</u>T<u>CG</u>CTGTCTCC<u>CG</u>CTTCTT | 75 | 2.62 | ND | ND |
| 1967 | T<u>CG</u>T<u>CG</u>CTGTCTGCCCTTCTT | 82 | 5.82 | 1.64 | 8.32 |
| 1968 | T<u>CG</u>T<u>CG</u>CTGTTGT<u>CG</u>TTTCTT | 83 | 3.77 | 5.26 | 5.12 |
| 1979$^2$ | TCCATGTZGTTCCTGTZGTT | 84 | 1.32 | ND | ND |

TABLE 11-continued

Induction of NK LU by Phoshorothioate CpG ODN with Good Motifs

| ODN[1] cells alone | sequence (5'-3') | SEQ ID NO: | expt. 1 0.00 | expt. 2 1.26 | expt. 3 0.46 |
|---|---|---|---|---|---|
| 1982 | TCCAGGACTTCTCTCAAGTT | 751 | 0.05 | ND | 0.98 |
| 1990 | TCCATGCGTGCGTGCGTTTT | 86 | 2.10 | ND | ND |
| 1991 | TCCATGCGTTGCGTTGCGTT | 87 | 0.89 | ND | ND |
| 2002 | TCCACGACGTTTTCGACGTT | 88 | 4.02 | 1.31 | 9.79 |
| 2005 | TCGTCGTTGTCGTTGTCGTT | 89 | ND | 4.22 | 12.73 |
| 2006 | TCGTCGTTTTGTCGTTTTGTCGT | 752 | ND | 6.17 | 12.82 |
| 2007 | TCGTCGTTGTCGTTTTGTCGTT | 91 | ND | 2.68 | 9.65 |
| 2008 | GCGTGCGTTGTCGTTGTCGTT | 92 | ND | 1.37 | 8.15 |
| 2010 | GCGGCGGGCGGCGCGCGCCC | 93 | ND | 0.01 | 0.05 |
| 2012 | TGTCGTTTGTCGTTTGTCGTT | 94 | ND | 2.02 | 11.61 |
| 2013 | TGTCGTTGTCGTTGTCGTTGTCGTT | 95 | ND | 0.56 | 5.22 |
| 2014 | TGTCGTTGTCGTTGTCGTT | 96 | ND | 5.74 | 10.89 |
| 2015 | TCGTCGTCGTCGTT | 97 | ND | 4.53 | 10.13 |
| 2016 | TGTCGTTGTCGTT | 98 | ND | 6.54 | 8.06 |

[1]PBMC essentially as described herein. Results are representative of 6 separate experiments; each experiment represents a different donor.
[2]This is the methylated version of ODN 1840 (SEQ ID NO: 83); Z = 5-methyl cytosine at residues 8 and 17; LU is lytic units; ND = not done; CpG dinucleotides are underlined for clarity

TABLE 12

Induction of human B cell proliferation by Phosphorothicate CpG ODN

| | | Stimulation Index[1] | | | | | |
|---|---|---|---|---|---|---|---|
| ODN sequence (5'-3') | SEQ ID NO: | expt. 1 | expt. 2 | expt. 3 | expt. 4 | expt. 5 | expt. 6 |
| 1840 TCCATGTCGTTCCTGTCGTT | 73 | 4 | ND | ND | ND | ND | 34 |
| 1841 TCCATAGCGTTCCTAGCGTT | 74 | 3 | ND | ND | ND | ND | ND |
| 1960 TCCTGTCGTTCCTGTCGTT | 77 | ND | 2.0 | 2.0 | 3.6 | ND | ND |
| 1961 TCCATGTCGTTTTTGTCGTT | 78 | 2 | 3.9 | 1.9 | 3.7 | ND | 37 |
| 1962 TCCTGTCGTTCCTTGTCGTT | 79 | ND | 3.9 | 1.9 | 3.9 | 5.4 | 35 |
| 1963 TCCTTGTCGTTCCTGTCGTT | 80 | 3 | ND | ND | ND | ND | ND |
| 1965 TCCTGTCGTTTTTTGTCGTT | 81 | 4 | 3.7 | 2.4 | 4.7 | 6.0 | 43 |
| 1967 TCGTCGTGTCTGCCCTTCTT | 82 | ND | 4.4 | 2.0 | 4.5 | 5.0 | 38 |
| 1968 TCGTCGCTGTGTCGTTTCTT | 83 | ND | 4.0 | 2.0 | 4.9 | 8.7 | 38 |
| 1982 TCCAGGACTTCTCTCAGGTT | 85 | 3 | 1.8 | 1.3 | 3.1 | 3.2 | 12 |
| 2002 TCCACGACGTTTTCGACGTT | 88 | ND | 2.7 | 1.4 | 4.4 | ND | 14 |

TABLE 12-continued

Induction of human B cell proliferation by Phosphorothicate CpG ODN

| ODN sequence (5'-3') | SEQ ID NO: | Stimulation Index[1] | | | | | |
|---|---|---|---|---|---|---|---|
| | | expt. 1 | expt. 2 | expt. 3 | expt. 4 | expt. 5 | expt. 6 |
| 2005 TCGTCGTTGTCGTTGTCGTT | 89 | 5 | 3.2 | 1.2 | 3.0 | 7.9 | 37 |
| 2006 TCGTCGTTTTGTCGTTTTGTCGTT | 90 | 4 | 4.5 | 2.2 | 5.8 | 8.3 | 40 |
| 2007 TCGTCGTTGTCGTTTTGTCGTT | 91 | 3 | 4.0 | 4.2 | 4.1 | ND | 22 |
| 2008 GCGTGCGTTGTCGTTGTCGTT | 92 | ND | 3.0 | 2.4 | 1.6 | ND | 12 |
| 2010 GCGGCGGGCGGCGCGCGCCC | 93 | ND | 1.6 | 1.9 | 3.2 | ND | ND |
| 2012 TGTCGTTTGTCGTTGTCGTT | 94 | 2 | 2.8 | 0 | 3.2 | ND | 33 |
| 2013 TGTCGTTGTCGTTGTCGTTGTCGTT | 95 | 3 | 2.3 | 3.1 | 2.8 | ND | 7 |
| 2014 TGTCGTTGTCGTTGTCGTT | 96 | 3 | 2.5 | 4.0 | 3.2 | 6.7 | 14 |
| 2015 TCGTCGTCGTCGTT | 97 | 5 | 1.8 | 2.6 | 4.5 | 9.4 | 1 |
| 2016 TGTCGTTGTCGTT | 98 | ND | 1.1 | 1.7 | 2.7 | 7.3 | 1 |

[1]Cells = human spleen cells stored at −70° C. after surgical harvest or PBNC collected from normal donors and spun over Ficoll. Cells were cultured in 96 well U-bottom microtiter pisten with or without the indicated ODN (which were added to cultured at 6 μml). N = 12 experiments. Cells were cultured for 4-7 days, pulsed with 1 μCi of ³H thymidine for 18 hr before harvest and scintillation counting. Stimulation index = the ratio of cpm in wells without ODN to that in wells that had been stimulated throughout the culture period with the indicated ODN (then were no further additions of ODN after the culture were set up). ND = not done

TABLE 13

Induction of human IL-12 secretion by Phophorothicate CpG ODN

| ODN[1] sequence (5'-3') | SEQ ID no | IL-12 (pg/ml) | |
|---|---|---|---|
| | | expt. 1 | expt. 2 |
| cells alone | | 0 | 0 |
| 1962 TCCTGTCGTTCCTTGTCGTT | 79 | 19 | 0 |
| 1965 TCCTGTCGTTTTTTGTCGTT | 81 | 36 | 0 |
| 1967 TCGTCGCTGTCTGCCCTTCTT | 82 | 41 | 0 |
| 1968 TCGTCGCTGTTGTCGTTTCTT | 83 | 24 | 0 |
| 2005 TCGTCGTTGTCGTTGTCGTT | 89 | 25 | 0 |
| 2006 TCGTCGTTTTGTCGTTTTGTCGTT | 90 | 29 | 15 |
| 2014 TGTCGTTGTCGTTGTCGTT | 96 | 28 | 0 |
| 2015 TCGTCGTCGTCGTT | 97 | 14 | 0 |
| 2016 TGTCGTTGTCGTT | 98 | 3 | 0 |

[1]PBMC were collected from normal donors and spun over Ficoll, then cultured at 10⁶ cells/well in 96 well microtiter plates with or without the indicated ODN which were added to cultures at 6 μg/ml. Supernatants were collected at 24 hr and tested for IL-12 levels by ELISA as described in methods. A standard curve was run in each experiment, which represents a different donor.

TABLE 14

Different CpG motifs stimulate optimal murine B cell and NK activation

| ODN | Sequence | B cell activation[1] | NK activation[2] |
|---|---|---|---|
| 1668 | TCCATGACGTTCCTGATGCT (SEQ ID NO: 24) | 42,849 | 2.52 |
| 1758 | TCTCCCAGCGTGCGCCAT (SEQ ID NO: 59) | 1,747 | 6.66 |
| NONE | | | |

CpG dinucleotides are underlined; oligonucleotides were synthesized with phosphorothioate modified backbones to improve their nuclease resistance.
[1]Measured by ³H thymidine incorporation after 48 hr culture with oligodeoxynucleotides at a 200 nM concentration as described in Example 1.
[2]Measured in lytic units.

TABLE 15

Specific blockade of CpG-induced TNF-α and IL-12 expression by inhibitors of endosomal acidification or NFκB activation

| | Medium | | Inhibitors: Bafilomycin (250 nM) | | Chloroquine (2.5 μg/ml) | | Monensin (10 μM) | | NAC (50 mM) | TPCK (50 μM) | Gliotoxin (0.1 μg/ml) | Bisgliotoxin (0.1 μg/ml) |
|---|---|---|---|---|---|---|---|---|---|---|---|---|
| activators | TNF-α | IL-12 | TNF-α | IL-12 | TNF-α | IL-12 | TNF-α | IL-12 | TNF-α | TNF-α | TNF-α | TNF-α |
| Medium | 37 | 147 | 46 | 102 | 27 | 20 | 22 | 73 | 10 | 24 | 17 | 41 |
| CpG ODN | 455 | 17,114 | 71 | 116 | 28 | 6 | 49 | 777 | 54 | 23 | 31 | 441 |
| LPS | 901 | 22,485 | 1370 | 4051 | 1025 | 12418 | 491 | 4796 | 417 | 46 | 178 | 1120 |

TABLE 15 legend IL-12 and TNF-α assays: The murine monocyte cell line 3774 (1 × 10$^5$ cells/ml for IL 12 or 1 × 10$^6$ cells/ml for TNF-α), were cultured with or without the indicated inhibitors at the concentrations shown for 2 hr and then stimulated with the CpG oligodeoxynucleotide (ODN) 1826 (TCCATGACGT-TCCTGACGTT SEQ ID NO: 10) at 2 μM or LPS (10 μg/ml) for 4 hr (TNF-α or 24 hr (IL-12) at which time the supernatant was harvested. ELISA for IL-12 or TNF-α (pg/ml) was performed on the supernatants essentially as described (A. K. Krieg, A.-K. Yi, S. Matson, T. J. Waldschmidt, G. A. Bishop, R. Teasdale, G. Koretzky and D. Klinman, Nature 374, 546 (1995); Yi, A.-K., D. M. Klinman, T. L. Martin, S. Matson and A. M. Krieg, J. Immunol., 157, 5394-5402 (1996); Krieg, A. M., J. Lab. Clin. Med., 128, 128-133 (1996). Cells cultured with ODN that lacked CpG motifs did not induce cytokine secretion. Similar specific inhibition of CpG responses was seen with IL-6 assays, and in experiments using primary spleen cells or the B cell lines CH12.LX and WEHI-231.2.5 μg/ml of chloroquine is equivalent to <5 μM. Other inhibitors of NF-κB activation including PDTC and calpain inhibitors I and II gave similar results to the inhibitors shown. The results shown are representative of those obtained in ten different experiments.

U.S. Pat. No. 6,339,068 B1

TABLE 3

Plasmids containing immunostimulatory CpG motifs

| Plasmid | Backbone | No. CpG Motifs | Species specificity and ODN Equivalence of CpG-S Insert |
|---|---|---|---|
| pMCG-16 | pMAS | 16 | mouse-specific CpG motif #1826[1] |
| pMCG-50 | pMAS | 50 | |
| pMCG-100 | pMAS | 300 | |
| pMCG-200 | pMAS | 200 | |
| pHCG-30 | pMAS | 30 | human-specific CpG motif- no ODN equivalent[2] |
| pHCG-50 | pMAS | 50 | |
| pHCG-100 | pMAS | 100 | |
| pHCG-200 | pMAS | 200 | |
| pHIS-40 | pMAS | 40 | human-specific CpG motif #2006[3] |
| pHIS-64 | pMAS | 64 | |
| pHIS-128 | pMAS | 128 | |
| pHIS-192 | pMAS | 192 | |

[1] sequence of 1826 is TCCATGACGTTCCTGACGTT (SEQ ID NO: 60)
[2] sequence used as a source of CpG motifs is GACTTCGTGTCGTTCTTCTGTCGTCTTTAGCGCTTCTCCTGCGTGCGTCCCTTG (SEQ ID NO: 753)
[3] sequence of 2006 is TCGTCGTTTTGTCGTTTTGTCGTT (SEQ ID NO: 90)

TABLE 4

Plasmids encoding hepatitis B surface antigen (derived from ayw or adw subtypes of HBV)

| Plasmid | Backbone | Insert |
|---|---|---|
| pUK-S | pUK21-A2 | HBV-S (ayw) |
| pUKAX-S | pUK21-AX* | HBV-S (ayw) |
| pMAS-S | pMAS | HBV-S (ayw) |
| pMCG16-S | pMCG-16 | HBV-S (ayw) |
| pMCG50-S | pMCG-60 | HBV-S (ayw) |
| pMCG100-S | pMCG-100 | HBV-S (ayw) |
| pMCG200-S | pMCG-200 | HBV-S (ayw) |
| pHCG30-S | pHCG-30 | HBV-S (ayw) |
| pHCG50-S | pHCG-50 | HBV-S (ayw) |
| pHCG100-S | pHCG-100 | HBV-S (ayw) |
| pHCG200-S | pHCG-200 | HBV-S (ayw) |
| pHIS40-S(ad) | pHIS-40 | HBV-S(adw2) |
| pHIS64-S(ad) | pHIS-64 | HBV-S(adw2) |
| pHIS128-S(ad) | pHIS-128 | HBV-S(adw2) |
| pHIS192-S(ad) | PHIS-192 | HBV-S(adw2) |

*pUK21-AX was created by deleting f1 origin from pUK21-A

TABLE 6

ODN used with plasmid DNA

| Backbone | ODN code number | Sequence |
|---|---|---|
| S-ODN | 1826 | (SEQ ID NO: 100) TCCATGACGTTCCTGACGTT |
| | 1628 | (SEQ ID NO: 754) GGGGTCAACGTTGAGGGGGG |
| | 1911 | (SEQ ID NO: 755) TCCAGGACTTTCCTCAGGTT |
| | 1982 | (SEQ ID NO: 85) TCCAGGACTTCTCTCAGGTT |
| | 2017 | (SEQ ID NO: 756) CCCCCCCCCCCCCCCCCCCC |
| O-ODN | 2061 | (SEQ ID NO: 100) TCCATGACGTTCCTGACGTT |
| | 2001 | (SEQ ID NO: 757) GGCGGCGGCGGCGGCGGCGG |
| SOS-ODN | 1980 | (SEQ ID NO: 100) TCCATGACGTTCCTGACGTT |
| | 1585 | (SEQ ID NO: 758) GGGTCAACGTTGAGGGGGG |
| | 1844 | (SEQ ID NO: 759) TCTCCCAGCGTGCGCCATAT |
| | 1972 | (SEQ ID NO: 760) GGGGTCTGTGCTTTTGGGGGG |
| | 2042 | (SEQ ID NO: 761) TCAGGGGTGGGGGGAACCTT |
| | 1981 | (SEQ ID NO: 762) GGGGTTGACGTTTTGGGGGG |
| | 2018 | (SEQ ID NO: 763) TCTAGCGTTTTTAGCGTTCC |
| | 2021 | (SEQ ID NO: 89) TCGTCGTTGTCGTTGTCGTT |
| | 2022 | (SEQ ID NO: 90) TCGTCGTTTTGTCGTTTTGTCGTT |

TABLE 6-continued

ODN used with plasmid DNA

| Backbone | ODN code number | Sequence |
|---|---|---|
| | 2023 | (SEQ ID NO: 91) TCGTCGTTGTCGTTTTGTCGTT |

TABLE 10

Inhibitory CpG motifs can block B cell proliferation induced by a stimulatory CpG motif

| Oligonucleotide added | |
|---|---|
| medium | 194 |
| 1668 (TCCATGACGTTCCTGATGCT)(SEQ ID NO: 24) | 34,669 |
| 1668 + 1735 (GCGTTTTTTTTGCG)(SEQ ID NO: 764) | 24,452 |
| 1720 (TCCATGAGCTTCCTGATGCT)(SEQ ID NO: 765) | 601 |
| 1720 + 1735 | 1109 |

TABLE 11

Inhibitory effects of "bad" CpG motifs on the "good" CpG Oligo 1619

| Oligonucleotide added | I:-12 in pg/ml |
|---|---|
| medium | 0 |
| 1619 alone | 6 |
| 1619 + 1949 (TCCATGTCGTTCCTGATGCG (SEQ ID NO: 766)) | 16 |
| 1619 + 1952 (TCCATGTCGTTCCGCGCGCG (SEQ ID NO: 767)) | 0 |
| 1619 + 1953 (TCCATGTCGTTCCTGCCGCT (SEQ ID NO: 768)) | 0 |
| 1619 + 1955 (GCGGCGGGCGGCGCGCGCCC (SEQ ID NO: 93)) | 0 |

Notes:
The sequence of oligo 1619 is TCCATGTCGTTCCTGATGCT (SEQ ID NO: 48) 1949 has only 1 GCG at the 3' end, which has essentially no inhibitory activity

TABLE 13

Identification of neutralizing CpG motifs which reduce the induction of cytokine secretion by a CpG-S motif in the same ODN (cis-neutralization)

| | | ODN-induced cytokine expression[2] | | |
|---|---|---|---|---|
| ODN | sequence 5'-3'[1] | IL-6[2] | IL-12 | IFN-γ |
| None | | <5 | 206 | 898 |
| 1619 | TCCATGTCGTTCCTGATGCT (SEQ ID NO: 48) | 1405 | 3130 | 4628 |
| 1952 | ............GCGCGCG (SEQ ID NO: 767) | 559 | 1615 | 2135 |
| 1953 | ............CC... (SEQ ID NO: 768) | 557 | 1854 | 2000 |

[1]Dots in the sequence of ODN 1952 and 1953 indicate identity to ODN 1619; CpG dinucleotides are underlined for clarity. ODN without CpG-N or CpG-S motifs had little or no effect on cytokine production. The data shown are representative of 4 experiments.
[2]All cytokines are given in pg/ml; measured by ELISA on supernatants from DBA/2 spleen cells cultured in 96 well plates at $2 \times 10^7$ cells/ml for 24 hr with the indicated ODN at 30 μg/ml. Std. dev. of the triplicate wells was <7%. None of the ODN induced significant amounts of IL-5.

TABLE 14

Inhibition of CpG-induced cytokine secretion by ODN containing CpG-N motifs

| ODN | sequence 5'-3' | IL-12 secretion[1] | CpG-S-induced IL-12 secretion[2] |
|---|---|---|---|
| none | | 268 | 5453 |
| 1895 | GCGCGCGCGCGCGCGCGCGC (SEQ ID NO: 769) | 123 | 2719 |
| 1896 | CCGGCCGGCCGGCCGGCCGG (SEQ ID NO: 770) | 292 | 2740 |
| 1959 | GCGGCGGGCGGCGCGCGCCC (SEQ ID NO: 93) | 270 | 2539 |
| 2037 | TCCATGCCGTTCCTGCCGTT (SEQ ID NO: 771) | 423 | 2847 |

[1]RALB/c spleen cells were cultured in 96 well plates at $2 \times 10^7$ cells/ml with the indicated ODN for 24 hr and then the supernatants were assayed for IL-12 by ELISA (pg/ml).
[2]Cells were set up the same as in [1] except that IL-12 secretion was induced by the addition of the CpG ODN 1619 (TCCATGTCGT-TCCTGATGCT (SEQ ID NO: 48)) at 30 μg/ml. The data shown are representative of 5 experiments.

Appendix (C)

Exemplary Human miRNA Sequences

>hsa-let-7a-1 MI0000060 (SEQ ID NO: 772)
UGGGAUGAGGUAGUAGGUUGUAUAGUUUUAGGGUCACACCCACCACUGGGAGAUAACUAUACAAUCUACUGUCUUUC
CUA >hsa-let-7a-2 MI0000061 (SEQ ID NO: 773)
AGGUUGAGGUAGUAGGUUGUAUAGUUUAGAAUUACAUCAAGGGAGAUAACUGUACAGCCUCCUAGCUUUCCU >hsa-let-7a-3 MI0000062 (SEQ ID NO: 774)
GGGUGAGGUAGUAGGUUGUAUAGUUUGGGGCUCUGCCCUGCUAUGGGAUAACUAUACAAUCUACUGUCUUUCCU -continued >hsa-let-7b MI0000063 (SEQ ID NO: 775)
CGGGGUGAGGUAGUAGGUUGUGUGGUUUCAGGGCAGUGAUGUUGCCCCUCGGAAGAUAACUAUACAACCUACUGCCU
UCCCUG >hsa-let-7c MI0000064 (SEQ ID NO: 776)
GCAUCCGGGUUGAGGUAGUAGGUUGUAUGGUUUAGAGUUACACCCUGGGAGUUAACUGUACAACCUUCUAGCUUUCC
UUGGAGC >hsa-let-7d MI0000065 (SEQ ID NO: 777)
CCUAGGAAGAGGUAGUAGGUUGCAUAGUUUUAGGGCAGGGAUUUUGCCCACAAGGAGGUAACUAUACGACCUGCUGC
CUUUCUUAGG >hsa-let-7e MI0000066 (SEQ ID NO: 778)
CCCGGGCUGAGGUAGGAGGUUGUAUAGUUGAGGAGGACACCCAAGGAGAUCACUAUACGGCCUCCUAGCUUUCCCCA
GG >hsa-let-7f-1 MI0000067 (SEQ ID NO: 779)
UCAGAGUGAGGUAGUAGAUUGUAUAGUUGUGGGGUAGUGAUUUUACCCUGUUCAGGAGAUAACUAUACAAUCUAUUG
CCUUCCCUGA >hsa-let-7f-2 MI0000068 (SEQ ID NO: 780)
UGUGGGAUGAGGUAGUAGAUUGUAUAGUUUUAGGGUCAUACCCCAUCUUGGAGAUAACUAUACAGUCUACUGUCUUU
CCCACG >hsa-let-7g MI0000433 (SEQ ID NO: 781)
AGGCUGAGGUAGUAGUUUGUACAGUUUGAGGGUCUAUGAUACCACCCGGUACAGGAGAUAACUGUACAGGCCACUGC
CUUGCCA >hsa-let-7i MI0000434 (SEQ ID NO: 782)
CUGGCUGAGGUAGUAGUUUGUGCUGUUGGUCGGGUUGUGACAUUGCCCGCUGUGGAGAUAACUGCGCAAGCUACUGC
CUUGCUA >hsa-mir-1-1 MI0000651 (SEQ ID NO: 783)
UGGGAAACAUACUUCUUUAUAUGCCCAUAUGGACCUGCUAAGCUAUGGAAUGUAAAGAAGUAUGUAUCUCA >hsa-mir-1-2 MI0000437 (SEQ ID NO: 784)
ACCUACUCAGAGUACAUACUUCUUUAUGUACCCAUAUGAACAUACAAUGCUAUGGAAUGUAAAGAAGUAUGUAUUUU
UGGUAGGC >hsa-mir-7-1 MI0000263 (SEQ ID NO: 785)
UUGGAUGUUGGCCUAGUUCUGUGUGGAAGACUAGUGAUUUUGUUGUUUUUAGAUAACUAAAUCGACAACAAAUCACA
GUCUGCCAUAUGGCACAGGCCAUGCCUCUACAG >hsa-mir-7-2 MI0000264 (SEQ ID NO: 786)
CUGGAUACAGAGUGGACCGGCUGGCCCCAUCUGGAAGACUAGUGAUUUUGUUGUUGUCUUACUGCGCUCAACAACAA
AUCCCAGUCUACCUAAUGGUGCCAGCCAUCGCA >hsa-mir-7-3 MI0000265 (SEQ ID NO: 787)
AGAUUAGAGUGGCUGUGGUCUAGUGCUGUGUGGAAGACUAGUGAUUUUGUUGUUCUGAUGUACUACGACAACAAGUC
ACAGCCGGCCUCAUAGCGCAGACUCCCUUCGAC >hsa-mir-9-1 MI0000466 (SEQ ID NO: 788)
CGGGGUUGGUUGUUAUCUUUGGUUAUCUAGCUGUAUGAGUGGUGUGGAGUCUUCAUAAAGCUAGAUAACCGAAAGUA
AAAAUAACCCCA >hsa-mir-9-2 MI0000467 (SEQ ID NO: 789)
GGAAGCGAGUUGUUAUCUUUGGUUAUCUAGCUGUAUGAGUGUAUUGGUCUUCAUAAAGCUAGAUAACCGAAAGUAAA
AACUCCUUCA >hsa-mir-9-3 MI0000468 (SEQ ID NO: 790)
GGAGGCCCGUUUCUCUCUUUGGUUAUCUAGCUGUAUGAGUGCCACAGAGCCGUCAUAAAGCUAGAUAACCGAAAGUA
GAAAUGAUUCUCA >hsa-mir-10a MI0000266 (SEQ ID NO: 791)
GAUCUGUCUGUCUUCUGUAUAUACCCUGUAGAUCCGAAUUUGUGUAAGGAAUUUUGUGGUCACAAAUUCGUAUCUAG
GGGAAUAUGUAGUUGACAUAAACACUCCGCUCU >hsa-mir-10b MI0000267 (SEQ ID NO: 792)
CCAGAGGUUGUAACGUUGUCUAUAUAUACCCUGUAGAACCGAAUUUGUGUGGUAUCCGUAUAGUCACAGAUUCGAUU
CUAGGGGAAUAUAUGGUCGAUGCAAAAACUUCA >hsa-mir-15a MI0000069 (SEQ ID NO: 793)
CCUUGGAGUAAAGUAGCAGCACAUAAUGGUUUGUGGAUUUUGAAAAGGUGCAGGCCAUAUUGUGCUGCCUCAAAAAU
ACAAGG >hsa-mir-15b MI0000438 (SEQ ID NO: 794)
UUGAGGCCUUAAAGUACUGUAGCAGCACAUCAUGGUUUACAUGCUACAGUCAAGAUGCGAAUCAUUAUUUGCUGCUC
UAGAAAUUUAAGGAAAUUCAU -continued >hsa-mir-16-1 MI0000070 (SEQ ID NO: 795)
GUCAGCAGUGCCUUAGCAGCACGUAAAUAUUGGCGUUAAGAUUCUAAAAUUAUCUCCAGUAUUAACUGUGCUGCUGA
AGUAAGGUUGAC >hsa-mir-16-2 MI0000115 (SEQ ID NO: 796)
GUUCCACUCUAGCAGCACGUAAAUAUUGGCGUAGUGAAAUAUAUAUUAAACACCAAUAUUACUGUGCUGCUUUAGUG
UGAC >hsa-mir-17 MI0000071 (SEQ ID NO: 797)
GUCAGAAUAAUGUCAAAGUGCUUACAGUGCAGGUAGUGAUAUGUGCAUCUACUGCAGUGAAGGCACUUGUAGCAUUA
UGGUGAC >hsa-mir-18a MI0000072 (SEQ ID NO: 798)
UGUUCUAAGGUGCAUCUAGUGCAGAUAGUGAAGUAGAUUAGCAUCUACUGCCCUAAGUGCUCCUUCUGGCA >hsa-mir-18b MI0001518 (SEQ ID NO: 799)
UGUGUUAAGGUGCAUCUAGUGCAGUUAGUGAAGCAGCUUAGAAUCUACUGCCCUAAAUGCCCCUUCUGGCA >hsa-mir-19a MI0000073 (SEQ ID NO: 800)
GCAGUCCUCUGUUAGUUUUGCAUAGUUGCACUACAAGAAGAAUGUAGUUGUGCAAAUCUAUGCAAAACUGAUGGUGG
CCUGC >hsa-mir-19b-1 MI0000074 (SEQ ID NO: 801)
CACUGUUCUAUGGUUAGUUUUGCAGGUUUGCAUCCAGCUGUGUGAUAUUCUGCUGUGCAAAUCCAUGCAAAACUGAC
UGUGGUAGUG >hsa-mir-19b-2 MI0000075 (SEQ ID NO: 802)
ACAUUGCUACUUACAAUUAGUUUUGCAGGUUUGCAUUUCAGCGUAUAUAUGUAUAUGUGGCUGUGCAAAUCCAUGCA
AAACUGAUUGUGAUAAUGU >hsa-mir-20a MI0000076 (SEQ ID NO: 803)
GUAGCACUAAAGUGCUUAUAGUGCAGGUAGUGUUUAGUUAUCUACUGCAUUAUGAGCACUUAAAGUACUGC >hsa-mir-20b MI0001519 (SEQ ID NO: 804)
AGUACCAAAGUGCUCAUAGUGCAGGUAGUUUUGGCAUGACUCUACUGUAGUAUGGGCACUUCCAGUACU >hsa-mir-21 MI0000077 (SEQ ID NO: 805)
UGUCGGGUAGCUUAUCAGACUGAUGUUGACUGUUGAAUCUCAUGGCAACACCAGUCGAUGGGCUGUCUGACA >hsa-mir-22 MI0000078 (SEQ ID NO: 806)
GGCUGAGCCGCAGUAGUUCUUCAGUGGCAAGCUUUAUGUCCUGACCCAGCUAAAGCUGCCAGUUGAAGAACUGUUGC
CCUCUGCC >hsa-mir-23a MI0000079 (SEQ ID NO: 807)
GGCCGGCUGGGGUUCCUGGGGAUGGGAUUUGCUUCCUGUCACAAAUCACAUUGCCAGGGAUUUCCAACCGACC >hsa-mir-23b MI0000439 (SEQ ID NO: 808)
CUCAGGUGCUCUGGCUGCUUGGGUUCCUGGCAUGCUGAUUUGUGACUUAAGAUUAAAAAUCACAUUGCCAGGGAUUAC
CACGCAACCACGACCUUGGC >hsa-mir-23c MI0016010 (SEQ ID NO: 809)
AGUGACUUUCCAGGUGUCACACAGUGAGUGGCAUAAUCAGAGUACAAUUUGAGUCAUGCCCAUACAUCACAUUGCCA
GUGAUUACCCAAGGAAAGUGACG >hsa-mir-24-1 MI0000080 (SEQ ID NO: 810)
CUCCGGUGCCUACUGAGCUGAUAUCAGUUCUCAUUUUACACACUGGCUCAGUUCAGCAGGAACAGGAG >hsa-mir-24-2 MI0000081 (SEQ ID NO: 811)
CUCUGCCUCCCGUGCCUACUGAGCUGAAACACAGUUGGUUUGUGUACACUGGCUCAGUUCAGCAGGAACAGGG >hsa-mir-25 MI0000082 (SEQ ID NO: 812)
GGCCAGUGUUGAGAGGCGGAGACUUGGGCAAUUGCUGGACGCUGCCCUGGGCAUUGCACUUGUCUCGGUCUGACAGU
GCCGGCC >hsa-mir-26a-1 MI0000083 (SEQ ID NO: 813)
GUGGCCUCGUUCAAGUAAUCCAGGAUAGGCUGUGCAGGUCCCAAUGGGCCUAUUCUUGGUUACUUGCACGGGGACGC >hsa-mir-26a-2 MI0000750 (SEQ ID NO: 814)
GGCUGUGGCUGGAUUCAAGUAAUCCAGGAUAGGCUGUUUCCAUCUGUGAGGCCUAUUCUUGAUUACUUGUUUCUGGA
GGCAGCU >hsa-mir-26b MI0000084 (SEQ ID NO: 815)
CCGGGACCCAGUUCAAGUAAUUCAGGAUAGGUUGUGUGCUGUCCAGCCUGUUCUCCAUUACUUGGCUCGGGGACCGG >hsa-mir-27a MI0000085 (SEQ ID NO: 816)
CUGAGGAGCAGGGCUUAGCUGCUUGUGAGCAGGGUCCACACCAAGUCGUGUUCACAGUGGCUAAGUUCCGCCCCCCAG >hsa-mir-27b MI0000440 (SEQ ID NO: 817)
ACCUCUCUAACAAGGUGCAGAGCUUAGCUGAUUGGUGAACAGUGAUUGGUUUCCGCUUUGUUCACAGUGGCUAAGUU
CUGCACCUGAAGAGAAGGUG >hsa-mir-28 MI0000086 (SEQ ID NO: 818)
GGUCCUUGCCCUCAAGGAGCUCACAGUCUAUUGAGUUACCUUUCUGACUUUCCCACUAGAUUGUGAGCUCCUGGAGG
GCAGGCACU >hsa-mir-29a MI0000087 (SEQ ID NO: 819)
AUGACUGAUUUCUUUUGGUGUUCAGAGUCAAUAUAAUUUUCUAGCACCAUCUGAAAUCGGUUAU >hsa-mir-29b-1 MI0000105 (SEQ ID NO: 820)
CUUCAGGAAGCUGGUUUCAUAUGGUGGUUUAGAUUUAAAUAGUGAUUGUCUAGCACCAUUUGAAAUCAGUGUUCUUG
GGGG >hsa-mir-29b-2 MI0000107 (SEQ ID NO: 821)
CUUCUGGAAGCUGGUUUCACAUGGUGGCUUAGAUUUUUCCAUCUUUGUAUCUAGCACCAUUUGAAAUCAGUGUUUUA
GGAG >hsa-mir-29c MI0000735 (SEQ ID NO: 822)
AUCUCUUACACAGGCUGACCGAUUUCUCCUGGUGUUCAGAGUCUGUUUUUGUCUAGCACCAUUUGAAAUCGGUUAUG
AUGUAGGGGGA >hsa-mir-30a MI0000088 (SEQ ID NO: 823)
GCGACUGUAAACAUCCUCGACUGGAAGCUGUGAAGCCACAGAUGGGCUUUCAGUCGGAUGUUUGCAGCUGC >hsa-mir-30b MI0000441 (SEQ ID NO: 824)
ACCAAGUUUCAGUUCAUGUAAACAUCCUACACUCAGCUGUAAUACAUGGAUUGGCUGGGAGGUGGAUGUUUACUUCA
GCUGACUUGGA >hsa-mir-30c-1 MI0000736 (SEQ ID NO: 825)
ACCAUGCUGUAGUGUGUGUAAACAUCCUACACUCUCAGCUGUGAGCUCAAGGUGGCUGGGAGAGGGUUGUUUACUCC
UUCUGCCAUGGA >hsa-mir-30c-2 MI0000254 (SEQ ID NO: 826)
AGAUACUGUAAACAUCCUACACUCUCAGCUGUGGAAAGUAAGAAAGCUGGGAGAAGGCUGUUUACUCUUUCU >hsa-mir-30d MI0000255 (SEQ ID NO: 827)
GUUGUUGUAAACAUCCCCGACUGGAAGCUGUAAGACACAGCUAAGCUUUCAGUCAGAUGUUUGCUGCUAC >hsa-mir-30e MI0000749 (SEQ ID NO: 828)
GGGCAGUCUUUGCUACUGUAAACAUCCUUGACUGGAAGCUGUAAGGUGUUCAGAGGAGCUUUCAGUCGGAUGUUUAC
AGCGGCAGGCUGCCA >hsa-mir-31 MI0000089 (SEQ ID NO: 829)
GGAGAGGAGGCAAGAUGCUGGCAUAGCUGUUGAACUGGGAACCUGCUAUGCCAACAUAUUGCCAUCUUUCC >hsa-mir-32 MI0000090 (SEQ ID NO: 830)
GGAGAUAUUGCACAUUACUAAGUUGCAUGUUGUCACGGCCUCAAUGCAAUUUAGUGUGUGUGAUAUUUUC >hsa-mir-33a MI0000091 (SEQ ID NO: 831)
CUGUGGUGCAUUGUAGUUGCAUUGCAUGUUCUGGUGGUACCCAUGCAAUGUUUCCACAGUGCAUCACAG >hsa-mir-33b MI0003646 (SEQ ID NO: 832)
GCGGGCGGCCCCGCGGUGCAUUGCUGUUGCAUUGCACGUGUGUGAGGCGGGUGCAGUGCCUCGGCAGUGCAGCCCGG
AGCCGGCCCCUGGCACCAC >hsa-mir-34a MI0000268 (SEQ ID NO: 833)
GGCCAGCUGUGAGUGUUUCUUUGGCAGUGUCUUAGCUGGUUGUUGUGAGCAAUAGUAAGGAAGCAAUCAGCAAGUAU
ACUGCCCUAGAAGUGCUGCACGUUGUGGGGCCC >hsa-mir-34b MI0000742 (SEQ ID NO: 834)
GUGCUCGGUUUGUAGGCAGUGUCAUUAGCUGAUUGUACUGUGGUGGUUACAAUCACUAACUCCACUGCCAUCAAAAC
AAGGCAC >hsa-mir-34c MI0000743 (SEQ ID NO: 835)
AGUCUAGUUACUAGGCAGUGUAGUUAGCUGAUUGCUAAUAGUACCAAUCACUAACCACACGGCCAGGUAAAAAGAUU >hsa-mir-92a-1 MI0000093 (SEQ ID NO: 836)
CUUUCUACACAGGUUGGGAUCGGUUGCAAUGCUGUGUUUCUGUAUGGUAUUGCACUUGUCCCGGCCUGUUGAGUUUGG >hsa-mir-92a-2 MI0000094 (SEQ ID NO: 837)
UCAUCCCUGGGUGGGGAUUUGUUGCAUUACUUGUGUUCUAUAUAAAGUAUUGCACUUGUCCCGGCCUGUGGAAGA >hsa-mir-92b MI0003560 (SEQ ID NO: 838)
CGGGCCCCGGGCGGGCGGGAGGGACGGGACGCGGUGCAGUGUUGUUUUUCCCCGCCAAUAUUGCACUCGUCCCGG
CCUCCGGCCCCCCGGCCC >hsa-mir-93 MI0000095 (SEQ ID NO: 839)
CUGGGGGCUCCAAAGUGCUGUUCGUGCAGGUAGUGUGAUUACCCAACCUACUGCUGAGCUAGCACUUCCCGAGCCCC
CGG >hsa-mir-95 MI0000097 (SEQ ID NO: 840)
AACACAGUGGGCACUCAAUAAAUGUCUGUUGAAUUGAAAUGCGUUACAUUCAACGGGUAUUUAUUGAGCACCCACUC
UGUG >hsa-mir-96 MI0000098 (SEQ ID NO: 841)
UGGCCGAUUUUGGCACUAGCACAUUUUUGCUUGUGUCUCUCCGCUCUGAGCAAUCAUGUGCAGUGCCAAUAUGGGAAA >hsa-mir-98 MI0000100 (SEQ ID NO: 842)
AGGAUUCUGCUCAUGCCAGGGUGAGGUAGUAAGUUGUAUUGUUGUGGGGUAGGGAUAUUAGGCCCCAAUUAGAAGAU
AACUAUACAACUUACUACUUUCCCUGGUGUGUGGCAUAUUCA >hsa-mir-99a MI0000101 (SEQ ID NO: 843)
CCCAUUGGCAUAAACCCGUAGAUCCGAUCUUGUGGUGAAGUGGACCGCACAAGCUCGCUUCUAUGGGUCUGUGUCAG
UGUG >hsa-mir-99b MI0000746 (SEQ ID NO: 844)
GGCACCCACCCGUAGAACCGACCUUGCGGGGCCUUCGCCGCACACAAGCUCGUGUCUGUGGGUCCGUGUC >hsa-mir-100 MI0000102 (SEQ ID NO: 845)
CCUGUUGCCACAAACCCGUAGAUCCGAACUUGUGGUAUUAGUCCGCACAAGCUUGUAUCUAUAGGUAUGUGUCUGUU
AGG >hsa-mir-101-1 MI0000103 (SEQ ID NO: 846)
UGCCCUGGCUCAGUUAUCACAGUGCUGAUGCUGUCUAUUCUAAAGGUACAGUACUGUGAUAACUGAAGGAUGGCA >hsa-mir-101-2 MI0000739 (SEQ ID NO: 847)
ACUGUCCUUUUUCGGUUAUCAUGGUACCGAUGCUGUAUAUCUGAAAGGUACAGUACUGUGAUAACUGAAGAAUGGUG
GU >hsa-mir-103a-1 MI0000109 (SEQ ID NO: 848)
UACUGCCCUCGGCUUCUUUACAGUGCUGCCUUGUUGCAUAUGGAUCAAGCAGCAUUGUACAGGGCUAUGAAGGCAUUG >hsa-mir-103a-2 MI0000108 (SEQ ID NO: 849)
UUGUGCUUUCAGCUUCUUUACAGUGCUGCCUUGUAGCAUUCAGGUCAAGCAGCAUUGUACAGGGCUAUGAAAGAACCA >hsa-mir-103b-1 MI0007261 (SEQ ID NO: 850)
UCAUAGCCCUGUACAAUGCUGCUUGAUCCAUAUGCAACAAGGCAGCACUGUAAAGAAGCCGA >hsa-mir-103b-2 MI0007262 (SEQ ID NO: 851)
UCAUAGCCCUGUACAAUGCUGCUUGACCUGAAUGCUACAAGGCAGCACUGUAAAGAAGCUGA >hsa-mir-105-1 MI0000111 (SEQ ID NO: 852)
UGUGCAUCGUGGUCAAAUGCUCAGACUCCUGUGGUGGCUGCUCAUGCACCACGGAUGUUUGAGCAUGUGCUACGGUG
UCUA >hsa-mir-105-2 MI0000112 (SEQ ID NO: 853)
UGUGCAUCGUGGUCAAAUGCUCAGACUCCUGUGGUGGCUGCUUAUGCACCACGGAUGUUUGAGCAUGUGCUAUGGUG
UCUA >hsa-mir-106a MI0000113 (SEQ ID NO: 854)
CCUUGGCCAUGUAAAAGUGCUUACAGUGCAGGUAGCUUUUUGAGAUCUACUGCAAUGUAAGCACUUCUUACAUUACC
AUGG >hsa-mir-106b MI0000734 (SEQ ID NO: 855)
CCUGCCGGGGCUAAAGUGCUGACAGUGCAGAUAGUGGUCCUCUCCGUGCUACCGCACUGUGGGUACUUGCUGCUCCA
GCAGG >hsa-mir-107 MI0000114 (SEQ ID NO: 856)
CUCUCUGCUUUCAGCUUCUUUACAGUGUUGCCUUGUGGCAUGGAGUUCAAGCAGCAUUGUACAGGGCUAUCAAAGCA
CAGA >hsa-mir-122 MI0000442 (SEQ ID NO: 857)
CCUUAGCAGAGCUGUGGAGUGUGACAAUGGUGUUUGUGUCUAAACUAUCAAACGCCAUUAUCACACUAAAUAGCUAC
UGCUAGGC >hsa-mir-124-1 MI0000443 (SEQ ID NO: 858)
AGGCCUCUCUCUCCGUGUUCACAGCGGACCUUGAUUUAAAUGUCCAUACAAUUAAGGCACGCGGUGAAUGCCAAGAA
UGGGGCUG >hsa-mir-124-2 MI0000444 (SEQ ID NO: 859)
AUCAAGAUUAGAGGCUCUGCUCUCCGUGUUCACAGCGGACCUUGAUUUAAUGUCAUACAAUUAAGGCACGCGGUGAA
UGCCAAGAGCGGAGCCUACGGCUGCACUUGAA >hsa-mir-124-3 MI0000445 (SEQ ID NO: 860)
UGAGGGCCCCUCUGCGUGUUCACAGCGGACCUUGAUUUAAUGUCUAUACAAUUAAGGCACGCGGUGAAUGCCAAGAG
AGGCGCCUCC >hsa-mir-125a MI0000469 (SEQ ID NO: 861)
UGCCAGUCUCUAGGUCCCUGAGACCCUUUAACCUGUGAGGACAUCCAGGGUCACAGGUGAGGUUCUUGGGAGCCUGG
CGUCUGGCC >hsa-mir-125b-1 MI0000446 (SEQ ID NO: 862)
UGCGCUCCUCUCAGUCCCUGAGACCCUAACUUGUGAUGUUUACCGUUUAAAUCCACGGGUUAGGCUCUUGGGAGCUG
CGAGUCGUGCU >hsa-mir-125b-2 MI0000470 (SEQ ID NO: 863)
ACCAGACUUUUCCUAGUCCCUGAGACCCUAACUUGUGAGGUAUUUUAGUAACAUCACAAGUCAGGCUCUUGGGACCU
AGGCGGAGGGGA >hsa-mir-126 MI0000471 (SEQ ID NO: 864)
CGCUGGCGACGGGACAUUAUUACUUUUGGUACGCGCUGUGACACUUCAAACUCGUACCGUGAGUAAUAAUGCGCCGU
CCACGGCA >hsa-mir-127 MI0000472 (SEQ ID NO: 865)
UGUGAUCACUGUCUCCAGCCUGCUGAAGCUCAGAGGGCUCUGAUUCAGAAAGAUCAUCGGAUCCGUCUGAGCUUGGC
UGGUCGGAAGUCUCAUCAUC >hsa-mir-128-1 MI0000447 (SEQ ID NO: 866)
UGAGCUGUUGGAUUCGGGGCCGUAGCACUGUCUGAGAGGUUUACAUUUCUCACAGUGAACCGGUCUCUUUUUCAGCU
GCUUC >hsa-mir-128-2 MI0000727 (SEQ ID NO: 867)
UGUGCAGUGGGAAGGGGGGCCGAUACACUGUACGAGAGUGAGUAGCAGGUCUCACAGUGAACCGGUCUCUUUCCCUA
CUGUGUC >hsa-mir-129-1 MI0000252 (SEQ ID NO: 868)
GGAUCUUUUUGCGGUCUGGGCUUGCUGUUCCUCUCAACAGUAGUCAGGAAGCCCUUACCCCAAAAAGUAUCU >hsa-mir-129-2 MI0000473 (SEQ ID NO: 869)
UGCCCUUCGCGAAUCUUUUUGCGGUCUGGGCUUGCUGUACAUAACUCAAUAGCCGGAAGCCCUUACCCCAAAAAGCA
UUUGCGGAGGGCG >hsa-mir-130a MI0000448 (SEQ ID NO: 870)
UGCUGCUGGCCAGAGCUCUUUUCACAUUGUGCUACUGUCUGCACCUGUCACUAGCAGUGCAAUGUUAAAAGGGCAUU
GGCCGUGUAGUG >hsa-mir-130b MI0000748 (SEQ ID NO: 871)
GGCCUGCCCGACACUCUUUCCCUGUUGCACUACUAUAGGCCGCUGGGAAGCAGUGCAAUGAUGAAAGGGCAUCGGUC
AGGUC >hsa-mir-132 MI0000449 (SEQ ID NO: 872)
CCGCCCCCGCGUCUCCAGGGCAACCGUGGCUUUCGAUUGUUACUGUGGGAACUGGAGGUAACAGUCUACAGCCAUGG
UCGCCCCGCAGCACGCCCACGCGC >hsa-mir-133a-1 MI0000450 (SEQ ID NO: 873)
ACAAUGCUUUGCUAGAGCUGGUAAAAUGGAACCAAAUCGCCUCUUCAAUGGAUUUGGUCCCCUUCAACCAGCUGUAG
CUAUGCAUUGA >hsa-mir-133a-2 MI0000451 (SEQ ID NO: 874)
GGGAGCCAAAUGCUUUGCUAGAGCUGGUAAAAUGGAACCAAAUCGACUGUCCAAUGGAUUUGGUCCCCUUCAACCAG
CUGUAGCUGUGCAUUGAUGGCGCCG >hsa-mir-133b MI0000822 (SEQ ID NO: 875)
CCUCAGAAGAAAGAUGCCCCCUGCUCUGGCUGGUCAAACGGAACCAAGUCCGUCUUCCUGAGAGGUUUGGUCCCCUU
CAACCAGCUACAGCAGGGCUGGCAAUGCCCAGUCCUUGGAGA >hsa-mir-134 MI0000474 (SEQ ID NO: 876)
CAGGGUGUGUGACUGGUUGACCAGAGGGGCAUGCACUGUGUUCACCCUGUGGGCCACCUAGUCACCAACCCUC >hsa-mir-135a-1 MI0000452 (SEQ ID NO: 877)
AGGCCUCGCUGUUCUCUAUGGCUUUUUAUUCCUAUGUGAUUCUACUGCUCACUCAUAUAGGGAUUGGAGCCGUGGCG
CACGGCGGGACA >hsa-mir-135a-2 MI0000453 (SEQ ID NO: 878)
AGAUAAAUUCACUCUAGUGCUUUAUGGCUUUUUAUUCCUAUGUGAUAGUAAUAAAGUCUCAUGUAGGGAUGGAAGCC
AUGAAAUACAUUGUGAAAAAUCA >hsa-mir-135b MI0000810 (SEQ ID NO: 879)
CACUCUGCUGUGGCCUAUGGCUUUUCAUUCCUAUGUGAUUGCUGUCCCAAACUCAUGUAGGGCUAAAAGCCAUGGGC
UACAGUGAGGGGCGAGCUCC >hsa-mir-136 MI0000475 (SEQ ID NO: 880)
UGAGCCCUCGGAGGACUCCAUUUGUUUUGAUGAUGGAUUCUUAUGCUCCAUCAUCGUCUCAAAUGAGUCUUCAGAGG
GUUCU >hsa-mir-137 MI0000454 (SEQ ID NO: 881)
GGUCCUCUGACUCUCUUCGGUGACGGGUAUUCUUGGGUGGAUAAUACGGAUUACGUUGUUAUUGCUUAAGAAUACGC
GUAGUCGAGGAGAGUACCAGCGGCA >hsa-mir-138-1 MI0000476 (SEQ ID NO: 882)
CCCUGGCAUGGUGUGGUGGGGCAGCUGGUGUUGUGAAUCAGGCCGUUGCCAAUCAGAGAACGGCUACUUCACAACAC
CAGGGCCACACCACACUACAGG >hsa-mir-138-2 MI0000455 (SEQ ID NO: 883)
CGUUGCUGCAGCUGGUGUUGUGAAUCAGGCCGACGAGCAGCGCAUCCUCUUACCCGGCUAUUUCACGACACCAGGGU
UGCAUCA >hsa-mir-139 MI0000261 (SEQ ID NO: 884)
GUGUAUUCUACAGUGCACGUGUCUCCAGUGUGGCUCGGAGGCUGGAGACGCGGCCCUGUUGGAGUAAC >hsa-mir-140 MI0000456 (SEQ ID NO: 885)
UGUGUCUCUCUCUGUGUCCUGCCAGUGGUUUUACCCUAUGGUAGGUUACGUCAUGCUGUUCUACCACAGGGUAGAAC
CACGGACAGGAUACCGGGGCACC >hsa-mir-141 MI0000457 (SEQ ID NO: 886)
CGGCCGGCCCUGGGUCCAUCUUCCAGUACAGUGUUGGAUGGUCUAAUUGUGAAGCUCCUAACACUGUCUGGUAAAGA
UGGCUCCCGGGUGGGUUC >hsa-mir-142 MI0000458 (SEQ ID NO: 887)
GACAGUGCAGUCACCCAUAAAGUAGAAAGCACUACUAACAGCACUGGAGGGUGUAGUGUUUCCUACUUUAUGGAUGA
GUGUACUGUG >hsa-mir-143 MI0000459 (SEQ ID NO: 888)
GCGCAGCGCCCUGUCUCCCAGCCUGAGGUGCAGUGCUGCAUCUCUGGUCAGUUGGGAGUCUGAGAUGAAGCACUGUA
GCUCAGGAAGAGAGAAGUUGUUCUGCAGC >hsa-mir-144 MI0000460 (SEQ ID NO: 889)
UGGGGCCCUGGCUGGGAUAUCAUCAUAUACUGUAAGUUUGCGAUGAGACACUACAGUAUAGAUGAUGUACUAGUCCG
GGCACCCCC >hsa-mir-145 MI0000461 (SEQ ID NO: 890)
CACCUUGUCCUCACGGUCCAGUUUUCCCAGGAAUCCCUUAGAUGCUAAGAUGGGGAUUCCUGGAAAUACUGUUCUUG
AGGUCAUGGUU >hsa-mir-146a MI0000477 (SEQ ID NO: 891)
CCGAUGUGUAUCCUCAGCUUUGAGAACUGAAUUCCAUGGGUUGUGUCAGUGUCAGACCUCUGAAAUUCAGUUCUUCA
GCUGGGAUAUCUCUGUCAUCGU >hsa-mir-146b MI0003129 (SEQ ID NO: 892)
CCUGGCACUGAGAACUGAAUUCCAUAGGCUGUGAGCUCUAGCAAUGCCCUGUGGACUCAGUUCUGGUGCCCGG >hsa-mir-147a MI0000262 (SEQ ID NO: 893)
AAUCUAAAGACAACAUUUCUGCACACACACCAGACUAUGGAAGCCAGUGUGUGGAAAUGCUUCUGCUAGAUU >hsa-mir-147b MI0005544 (SEQ ID NO: 894)
UAUAAAUCUAGUGGAAACAUUUCUGCACAAACUAGAUUCUGGACACCAGUGUGCGGAAAUGCUUCUGCUACAUUUUU
AGG >hsa-mir-148a MI0000253 (SEQ ID NO: 895)
GAGGCAAAGUUCUGAGACACUCCGACUCUGAGUAUGAUAGAAGUCAGUGCACUACAGAACUUUGUCUC >hsa-mir-148b MI0000811 (SEQ ID NO: 896)
CAAGCACGAUUAGCAUUUGAGGUGAAGUUCUGUUAUACACUCAGGCUGUGGCUCUCUGAAAGUCAGUGCAUCACAGA
ACUUUGUCUCGAAAGCUUUCUA >hsa-mir-149 MI0000478 (SEQ ID NO: 897)
GCCGGCGCCCGAGCUCUGGCUCCGUGUCUUCACUCCCGUGCUUGUCCGAGGAGGGAGGGAGGGACGGGGGCUGUGCU
GGGGCAGCUGGA >hsa-mir-150 MI0000479 (SEQ ID NO: 898)
CUCCCCAUGGCCCUGUCUCCCAACCCUUGUACCAGUGCUGGGCUCAGACCCUGGUACAGGCCUGGGGGACAGGGACC
UGGGGAC >hsa-mir-151a MI0000809 (SEQ ID NO: 899)
UUUCCUGCCCUCGAGGAGCUCACAGUCUAGUAUGUCUCAUCCCCUACUAGACUGAAGCUCCUUGAGGACAGGGAUGG
UCAUACUCACCUC >hsa-mir-151b MI0003772 (SEQ ID NO: 900)
ACCUCUGAUGUGUCAGUCUCUCUUCAGGGCUCCCGAGACACAGAAACAGACACCUGCCCUCGAGGAGCUCACAGUCU
AGACAAACAAACCCAGGGU >hsa-mir-152 MI0000462 (SEQ ID NO: 901)
UGUCCCCCCGGCCCAGGUUCUGUGAUACACUCCGACUCGGGCUCUGGAGCAGUCAGUGCAUGACAGAACUUGGGCC
CGGAAGGACC >hsa-mir-153-1 MI0000463 (SEQ ID NO: 902)
CUCACAGCUGCCAGUGUCAUUUUUGUGAUCUGCAGCUAGUAUUCUCACUCCAGUUGCAUAGUCACAAAAGUGAUCAU
UGGCAGGUGUGGC >hsa-mir-153-2 MI0000464 (SEQ ID NO: 903)
AGCGUGGCCAGUGUCAUUUUUGUGAUGUUGCAGCUAGUAAUAUGAGCCCAGUUGCAUAGUCACAAAAGUGAUCAUU
GGAAACUGUG >hsa-mir-154 MI0000480 (SEQ ID NO: 904)
GUGGUACUUGAAGAUAGGUUAUCCGUGUUGCCUUCGCUUUAUUUGUGACGAAUCAUACACGGUUGACCUAUUUUUCA
GUACCAA >hsa-mir-155 MI0000681 (SEQ ID NO: 905)
CUGUUAAUGCUAAUCGUGAUAGGGGUUUUUGCCUCCAACUGACUCCUACAUAUUAGCAUUAACAG >hsa-mir-181a-1 MI0000289 (SEQ ID NO: 906)
UGAGUUUUGAGGUUGCUUCAGUGAACAUUCAACGCUGUCGGUGAGUUUGGAAUUAAAAUCAAAACCAUCGACCGUUG
AUUGUACCCUAUGGCUAACCAUCAUCUACUCCA >hsa-mir-181a-2 MI0000269 (SEQ ID NO: 907)
AGAAGGGCUAUCAGGCCAGCCUUCAGAGGACUCCAAGGAACAUUCAACGCUGUCGGUGAGUUUGGGAUUUGAAAAAA
CCACUGACCGUUGACUGUACCUUGGGGUCCUUA >hsa-mir-181b-1 MI0000270 (SEQ ID NO: 908)
CCUGUGCAGAGAUUAUUUUUUAAAAGGUCACAAUCAACAUUCAUUGCUGUCGGUGGGUUGAACUGUGUGGACAAGCU
CACUGAACAAUGAAUGCAACUGUGGCCCCGCUU >hsa-mir-181b-2 MI0000683 (SEQ ID NO: 909)
CUGAUGGCUGCACUCAACAUUCAUUGCUGUCGGUGGGUUUGAGUCUGAAUCAACUCACUGAUCAAUGAAUGCAAACU
GCGGACCAAACA >hsa-mir-181c MI0000271 (SEQ ID NO: 910)
CGGAAAAUUUGCCAAGGGUUUGGGGGAACAUUCAACCUGUCGGUGAGUUUGGGCAGCUCAGGCAAACCAUCGACCGU
UGAGUGGACCCUGAGGCCUGGAAUUGCCAUCCU >hsa-mir-181d MI0003139 (SEQ ID NO: 911)
GUCCCCUCCCCUAGGCCACAGCCGAGGUCACAAUCAACAUUCAUUGUUGUCGGUGGGUUGUGAGGACUGAGGCCAGA
CCCACCGGGGAUGAAUGUCACUGUGGCUGGGCCAGACACGGCUUAAGGGGAAUGGGGAC >hsa-mir-182 MI0000272 (SEQ ID NO: 912)
GAGCUGCUUGCCUCCCCCCGUUUUUGGCAAUGGUAGAACUCACACUGGUGAGGUAACAGGAUCCGGUGGUUCUAGAC
UUGCCAACUAUGGGGCGAGGACUCAGCCGGCAC >hsa-mir-183 MI0000273 (SEQ ID NO: 913)
CCGCAGAGUGUGACUCCUGUUCUGUGUAUGGCACUGGUAGAAUUCACUGUGAACAGUCUCAGUCAGUGAAUUACCGA
AGGGCCAUAAACAGAGCAGAGACAGAUCCACGA >hsa-mir-184 MI0000481 (SEQ ID NO: 914)
CCAGUCACGUCCCCUUAUCACUUUUCCAGCCCAGCUUUGUGACUGUAAGUGUUGGACGGAGAACUGAUAAGGGUAGG
UGAUUGA >hsa-mir-185 MI0000482 (SEQ ID NO: 915)
AGGGGGCGAGGGAUUGGAGAGAAAGGCAGUUCCUGAUGGUCCCCUCCCCAGGGGCUGGCUUUCCUCUGGUCCUUCCC
UCCCA >hsa-mir-186 MI0000483 (SEQ ID NO: 916)
UGCUUGUAACUUUCCAAAGAAUUCUCCUUUUGGGCUUUCUGGUUUUAUUUUAAGCCCAAAGGUGAAUUUUUUGGGAA
GUUUGAGCU >hsa-mir-187 MI0000274 (SEQ ID NO: 917)
GGUCGGGCUCACCAUGACACAGUGUGAGACCUCGGGCUACAACACAGGACCCGGGCGCUGCUCUGACCCCUCGUGUC
UUGUGUUGCAGCCGGAGGGACGCAGGUCCGCA >hsa-mir-188 MI0000484 (SEQ ID NO: 918)
UGCUCCCUCUCUCACAUCCCUUGCAUGGUGGAGGGUGAGCUUUCUGAAAACCCCUCCCACAUGCAGGGUUUGCAGGA
UGGCGAGCC >hsa-mir-190a MI0000486 (SEQ ID NO: 919)
UGCAGGCCUCUGUGUGAUAUGUUUGAUAUAUUAGGUUGUUAUUUAAUCCAACUAUAUAUCAAACAUAUUCCUACAGU
GUCUUGCC >hsa-mir-190b MI0005545 (SEQ ID NO: 920)
UGCUUCUGUGUGAUAUGUUUGAUAUUGGGUUGUUUAAUUAGGAACCAACUAAAUGUCAAACAUAUUCUUACAGCAGC
AG >hsa-mir-191 MI0000465 (SEQ ID NO: 921)
CGGCUGGACAGCGGGCAACGGAAUCCCAAAAGCAGCUGUUGUCUCCAGAGCAUUCCAGCUGCGCUUGGAUUUCGUCC
CCUGCUCUCCUGCCU >hsa-mir-192 MI0000234 (SEQ ID NO: 922)
GCCGAGACCGAGUGCACAGGGCUCUGACCUAUGAAUUGACAGCCAGUGCUCUCGUCUCCCCUCUGGCUGCCAAUUCC
AUAGGUCACAGGUAUGUUCGCCUCAAUGCCAGC -continued >hsa-mir-193a MI0000487 (SEQ ID NO: 923)
CGAGGAUGGGAGCUGAGGGCUGGGUCUUUGCGGGCGAGAUGAGGGUGUCGGAUCAACUGGCCUACAAAGUCCCAGUU
CUCGGCCCCCG >hsa-mir-193b MI0003137 (SEQ ID NO: 924)
GUGGUCUCAGAAUCGGGGUUUUGAGGGCGAGAUGAGUUUAUGUUUUAUCCAACUGGCCCUCAAAGUCCCGCUUUUGG
GGUCAU >hsa-mir-194-1 MI0000488 (SEQ ID NO: 925)
AUGGUGUUAUCAAGUGUAACAGCAACUCCAUGUGGACUGUGUACCAAUUUCCAGUGGAGAUGCUGUUACUUUUGAUG
GUUACCAA >hsa-mir-194-2 MI0000732 (SEQ ID NO: 926)
UGGUUCCCGCCCCCUGUAACAGCAACUCCAUGUGGAAGUGCCCACUGGUUCCAGUGGGGCUGCUGUUAUCUGGGGCG
AGGGCCAG >hsa-mir-195 MI0000489 (SEQ ID NO: 927)
AGCUUCCCUGGCUCUAGCAGCACAGAAAUAUUGGCACAGGGAAGCGAGUCUGCCAAUAUUGGCUGUGCUGCUCCAGG
CAGGGUGGUG >hsa-mir-196a-1 MI0000238 (SEQ ID NO: 928)
GUGAAUUAGGUAGUUUCAUGUUGUUGGGCCUGGGUUUCUGAACACAACAACAUUAAACCACCCGAUUCAC >hsa-mir-196a-2 MI0000279 (SEQ ID NO: 929)
UGCUCGCUCAGCUGAUCUGUGGCUUAGGUAGUUUCAUGUUGUUGGGAUUGAGUUUUGAACUCGGCAACAAGAAACUG
CCUGAGUUACAUCAGUCGGUUUUCGUCGAGGGC >hsa-mir-196b MI0001150 (SEQ ID NO: 930)
ACUGGUCGGUGAUUUAGGUAGUUUCCUGUUGUUGGGAUCCACCUUUCUCUCGACAGCACGACACUGCCUUCAUUACU
UCAGUUG >hsa-mir-197 MI0000239 (SEQ ID NO: 931)
GGCUGUGCCGGGUAGAGAGGGCAGUGGGAGGUAAGAGCUCUUCACCCUUCACCACCUUCUCCACCCAGCAUGGCC >hsa-mir-198 MI0000240 (SEQ ID NO: 932)
UCAUUGGUCCAGAGGGGAGAUAGGUUCCUGUGAUUUUUCCUUCUUCUCUAUAGAAUAAAUGA >hsa-mir-199a-1 MI0000242 (SEQ ID NO: 933)
GCCAACCCAGUGUUCAGACUACCUGUUCAGGAGGCUCUCAAUGUGUACAGUAGUCUGCACAUUGGUUAGGC >hsa-mir-199a-2 MI0000281 (SEQ ID NO: 934)
AGGAAGCUUCUGGAGAUCCUGCUCCGUCGCCCCAGUGUUCAGACUACCUGUUCAGGACAAUGCCGUUGUACAGUAGU
CUGCACAUUGGUUAGACUGGGCAAGGGAGAGCA >hsa-mir-199b MI0000282 (SEQ ID NO: 935)
CCAGAGGACACCUCCACUCCGUCUACCCAGUGUUUAGACUAUCUGUUCAGGACUCCCAAAUUGUACAGUAGUCUGCA
CAUUGGUUAGGCUGGGCUGGGUUAGACCCUCGG >hsa-mir-200a MI0000737 (SEQ ID NO: 936)
CCGGGCCCCUGUGAGCAUCUUACCGGACAGUGCUGGAUUUCCCAGCUUGACUCUAACACUGUCUGGUAACGAUGUUC
AAAGGUGACCCGC >hsa-mir-200b MI0000342 (SEQ ID NO: 937)
CCAGCUCGGGCAGCCGUGGCCAUCUUACUGGGCAGCAUUGGAUGGAGUCAGGUCUCUAAUACUGCCUGGUAAUGAUG
ACGGCGGAGCCCUGCACG >hsa-mir-200c MI0000650 (SEQ ID NO: 938)
CCCUCGUCUUACCCAGCAGUGUUUGGGUGCGGUUGGGAGUCUCUAAUACUGCCGGGUAAUGAUGGAGG >hsa-mir-202 MI0003130 (SEQ ID NO: 939)
CGCCUCAGAGCCGCCCGCCGUUCCUUUUUCCUAUGCAUAUACUUCUUUGAGGAUCUGGCCUAAAGAGGUAUAGGGCA
UGGGAAAACGGGGCGGUCGGGUCCUCCCCAGCG >hsa-mir-203 MI0000283 (SEQ ID NO: 940)
GUGUUGGGGACUCGCGCGCUGGGUCCAGUGGUUCUUAACAGUUCAACAGUUCUGUAGCGCAAUUGUGAAAUGUUUAG
GACCACUAGACCCGGCGGGCGCGGCGACAGCGA >hsa-mir-204 MI0000284 (SEQ ID NO: 941)
GGCUACAGUCUUUCUUCAUGUGACUCGUGGACUUCCCUUUGUCAUCCUAUGCCUGAGAAUAUAUGAAGGAGGCUGGG
AAGGCAAAGGGACGUUCAAUUGUCAUCACUGGC >hsa-mir-205 MI0000285 (SEQ ID NO: 942)
AAAGAUCCUCAGACAAUCCAUGUGCUUCUCUUGUCCUUCAUUCCACCGGAGUCUGUCUCAUACCCAACCAGAUUUCA
GUGGAGUGAAGUUCAGGAGGCAUGGAGCUGACA >hsa-mir-206 MI0000490 (SEQ ID NO: 943)
UGCUUCCCGAGGCCACAUGCUUCUUUAUAUCCCCAUAUGGAUUACUUUGCUAUGGAAUGUAAGGAAGUGUGUGGUUU
CGGCAAGUG >hsa-mir-208a MI0000251 (SEQ ID NO: 944)
UGACGGGCGAGCUUUUGGCCCGGGUUAUACCUGAUGCUCACGUAUAAGACGAGCAAAAAGCUUGUUGGUCA >hsa-mir-208b MI0005570 (SEQ ID NO: 945)
CCUCUCAGGGAAGCUUUUUGCUCGAAUUAUGUUUCUGAUCCGAAUAUAAGACGAACAAAAGGUUUGUCUGAGGGCAG >hsa-mir-210 MI0000286 (SEQ ID NO: 946)
ACCCGGCAGUGCCUCCAGGCGCAGGGCAGCCCCUGCCCACCGCACACUGCGCUGCCCCAGACCCACUGUGCGUGUGA
CAGCGGCUGAUCUGUGCCUGGGCAGCGCGACCC >hsa-mir-211 MI0000287 (SEQ ID NO: 947)
UCACCUGGCCAUGUGACUUGUGGGCUUCCCUUUGUCAUCCUUCGCCUAGGGCUCUGAGCAGGGCAGGGACAGCAAAG
GGGUGCUCAGUUGUCACUUCCCACAGCACGGAG >hsa-mir-212 MI0000288 (SEQ ID NO: 948)
CGGGGCACCCCGCCCGGACAGCGCGCCGGCACCUUGGCUCUAGACUGCUUACUGCCCGGGCCGCCCUCAGUAACAGU
CUCCAGUCACGGCCACCGACGCCUGGCCCCGCC >hsa-mir-214 MI0000290 (SEQ ID NO: 949)
GGCCUGGCUGGACAGAGUUGUCAUGUGUCUGCCUGUCUACACUUGCUGUGCAGAACAUCCGCUCACCUGUACAGCAG
GCACAGACAGGCAGUCACAUGACAACCCAGCCU >hsa-mir-215 MI0000291 (SEQ ID NO: 950)
AUCAUUCAGAAAUGGUAUACAGGAAAAUGACCUAUGAAUUGACAGACAAUAUAGCUGAGUUUGUCUGUCAUUUCUUU
AGGCCAAUAUUCUGUAUGACUGUGCUACUUCAA >hsa-mir-216a MI0000292 (SEQ ID NO: 951)
GAUGGCUGUGAGUUGGCUUAAUCUCAGCUGGCAACUGUGAGAUGUUCAUACAAUCCCUCACAGUGGUCUCUGGGAUU
AUGCUAAACAGAGCAAUUUCCUAGCCCUCACGA >hsa-mir-216b MI0005569 (SEQ ID NO: 952)
GCAGACUGGAAAAUCUCUGCAGGCAAAUGUGAUGUCACUGAGGAAAUCACACACUUACCCGUAGAGAUUCUACAGUC
UGACA >hsa-mir-217 MI0000293 (SEQ ID NO: 953)
AGUAUAAUUAUUACAUAGUUUUUGAUGUCGCAGAUACUGCAUCAGGAACUGAUUGGAUAAGAAUCAGUCACCAUCAG
UUCCUAAUGCAUUGCCUUCAGCAUCUAAACAAG >hsa-mir-218-1 MI0000294 (SEQ ID NO: 954)
GUGAUAAUGUAGCGAGAUUUUCUGUUGUGCUUGAUCUAACCAUGUGGUUGCGAGGUAUGAGUAAAACAUGGUUCCGU
CAAGCACCAUGGAACGUCACGCAGCUUUCUACA >hsa-mir-218-2 MI0000295 (SEQ ID NO: 955)
GACCAGUCGCUGCGGGGCUUUCCUUUGUGCUUGAUCUAACCAUGUGGUGGAACGAUGGAAACGGAACAUGGUUCUGU
CAAGCACCGCGGAAAGCACCGUGCUCUCCUGCA >hsa-mir-219-1 MI0000296 (SEQ ID NO: 956)
CCGCCCCGGGCCGCGGCUCCUGAUUGUCCAAACGCAAUUCUCGAGUCUAUGGCUCCGGCCGAGAGUUGAGUCUGGAC
GUCCCGAGCCGCCGCCCCCAAACCUCGAGCGGG >hsa-mir-219-2 MI0000740 (SEQ ID NO: 957)
ACUCAGGGGCUUCGCCACUGAUUGUCCAAACGCAAUUCUUGUACGAGUCUGCGGCCAACCGAGAAUUGUGGCUGGAC
AUCUGUGGCUGAGCUCCGGG >hsa-mir-221 MI0000298 (SEQ ID NO: 958)
UGAACAUCCAGGUCUGGGGCAUGAACCUGGCAUACAAUGUAGAUUUCUGUGUUCGUUAGGCAACAGCUACAUUGUCU
GCUGGGUUUCAGGCUACCUGGAAACAUGUUCUC >hsa-mir-222 MI0000299 (SEQ ID NO: 959)
GCUGCUGGAAGGUGUAGGUACCCUCAAUGGCUCAGUAGCCAGUGUAGAUCCUGUCUUUCGUAAUCAGCAGCUACAUC
UGGCUACUGGGUCUCUGAUGGCAUCUUCUAGCU >hsa-mir-223 MI0000300 (SEQ ID NO: 960)
CCUGGCCUCCUGCAGUGCCACGCUCCGUGUAUUUGACAAGCUGAGUUGGACACUCCAUGUGGUAGAGUGUCAGUUUG
UCAAAUACCCCAAGUGCGGCACAUGCUUACCAG >hsa-mir-224 MI0000301 (SEQ ID NO: 961)
GGGCUUUCAAGUCACUAGUGGUUCCGUUUAGUAGAUGAUUGUGCAUUGUUUCAAAAUGGUGCCCUAGUGACUACAAA
GCCC >hsa-mir-296 MI0000747 (SEQ ID NO: 962)
AGGACCCUUCCAGAGGGCCCCCCCUCAAUCCUGUUGUGCCUAAUUCAGAGGGUUGGGUGGAGGCUCUCCUGAAGGGC
UCU >hsa-mir-297 MI0005775 (SEQ ID NO: 963)
UGUAUGUAUGUGUGCAUGUGCAUGUAUGUGUAUAUACAUAUAUAUGUAUUAUGUACUCAUAUAUCA >hsa-mir-298 MI0005523 (SEQ ID NO: 964)
UCAGGUCUUCAGCAGAAGCAGGGAGGUUCUCCCAGUGGUUUUCCUUGACUGUGAGGAACUAGCCGCUGCUUUGCUC
AGGAGUGAGCU -continued >hsa-mir-299 MI0000744 (SEQ ID NO: 965)
AAGAAAUGGUUUACCGUCCCACAUACAUUUUGAAUAUGUAUGUGGGAUGGUAAACCGCUUCUU >hsa-mir-300 MI0005525 (SEQ ID NO: 966)
UGCUACUUGAAGAGAGGUAAUCCUUCACGCAUUUGCUUUACUUGCAAUGAUUAUACAAGGGCAGACUCUCUCGGGG
AGCAAA >hsa-mir-301a MI0000745 (SEQ ID NO: 967)
ACUGCUAACGAAUGCUCUGACUUUAUUGCACUACUGUACUUUACAGCUAGCAGUGCAAUAGUAUUGUCAAAGCAUCU
GAAAGCAGG >hsa-mir-301b MI0005568 (SEQ ID NO: 968)
GCCGCAGGUGCUCUGACGAGGUUGCACUACUGUGCUCUGAGAAGCAGUGCAAUGAUAUUGUCAAAGCAUCUGGGACCA >hsa-mir-302a MI0000738 (SEQ ID NO: 969)
CCACCACUUAAACGUGGAUGUACUUGCUUUGAAACUAAAGAAGUAAGUGCUUCCAUGUUUUGGUGAUGG >hsa-mir-302b MI0000772 (SEQ ID NO: 970)
GCUCCCUUCAACUUUAACAUGGAAGUGCUUUCUGUGACUUUAAAAGUAAGUGCUUCCAUGUUUUAGUAGGAGU >hsa-mir-302c MI0000773 (SEQ ID NO: 971)
CCUUUGCUUUAACAUGGGGGUACCUGCUGUGUGAAACAAAAGUAAGUGCUUCCAUGUUUCAGUGGAGG >hsa-mir-302d MI0000774 (SEQ ID NO: 972)
CCUCUACUUUAACAUGGAGGCACUUGCUGUGACAUGACAAAAAUAAGUGCUUCCAUGUUUGAGUGUGG >hsa-mir-302e MI0006417 (SEQ ID NO: 973)
UUGGGUAAGUGCUUCCAUGCUUCAGUUUCCUUACUGGUAAGAUGGAUGUAGUAAUAGCACCUACCUUAUAGA >hsa-mir-302f MI0006418 (SEQ ID NO: 974)
UCUGUGUAAACCUGGCAAUUUUCACUUAAUUGCUUCCAUGUUUAUAAAAGA >hsa-mir-320a MI0000542 (SEQ ID NO: 975)
GCUUCGCUCCCUCCGCCUUCUCUUCCCGGUUCUUCCCGGAGUCGGGAAAAGCUGGGUUGAGAGGGCGAAAAAGGAU
GAGGU >hsa-mir-320b-1 MI0003776 (SEQ ID NO: 976)
AAUUAAUCCCUCUCUUUCUAGUUCUUCCUAGAGUGAGGAAAAGCUGGGUUGAGAGGGCAAACAAAUUAACUAAUUAA
UU >hsa-mir-320b-2 MI0003839 (SEQ ID NO: 977)
UGUUAUUUUUGUCUUCUACCUAAGAAUUCUGUCUCUUAGGCUUUCUCUUCCCAGAUUUCCCAAAGUUGGGAAAAGC
UGGGUUGAGAGGGCAAAAGGAAAAAAAAAGAAUUCUGUCUCUGACAUAAUUAGAUAGGGAA >hsa-mir-320c-1 MI0003778 (SEQ ID NO: 978)
UUUGCAUUAAAAAUGAGGCCUUCUCUUCCCAGUUCUUCCCAGAGUCAGGAAAAGCUGGGUUGAGAGGGUAGAAAAAA
AAUGAUGUAGG >hsa-mir-320c-2 MI0008191 (SEQ ID NO: 979)
CUUCUCUUUCCAGUUCUUCCCAGAAUUGGGAAAAGCUGGGUUGAGAGGGU >hsa-mir-320d-1 MI0008190 (SEQ ID NO: 980)
UUCUCGUCCCAGUUCUUCCCAAAGUUGAGAAAAGCUGGGUUGAGAGGA >hsa-mir-320d-2 MI0008192 (SEQ ID NO: 981)
UUCUCUUCCCAGUUCUUCUUGGAGUCAGGAAAAGCUGGGUUGAGAGGA >hsa-mir-320e MI0014234 (SEQ ID NO: 982)
GCCUUCUCUUCCCAGUUCUUCCUGGAGUCGGGGAAAAGCUGGGUUGAGAAGGU >hsa-mir-323a MI0000807 (SEQ ID NO: 983)
UUGGUACUUGGAGAGAGGUGGUCCGUGGCGCGUUCGCUUUAUUUAUGGCGCACAUUACACGGUCGACCUCUUUGCAG
UAUCUAAUC >hsa-mir-323b MI0014206 (SEQ ID NO: 984)
UGGUACUCGGAGGGAGGUUGUCCGUGGUGAGUUCGCAUUAUUUAAUGAUGCCCAAUACACGGUCGACCUCUUUUCGG
UAUCA >hsa-mir-324 MI0000813 (SEQ ID NO: 985)
CUGACUAUGCCUCCCCGCAUCCCCUAGGGCAUUGGUGUAAAGCUGGAGACCCACUGCCCCAGGUGCUGCUGGGGGUU
GUAGUC >hsa-mir-325 MI0000824 (SEQ ID NO: 986)
AUACAGUGCUUGGUUCCUAGUAGGUGUCCAGUAAGUGUUUGUGACAUAAUUUGUUUAUUGAGGACCUCCUAUCAAUC
AAGCACUGUGCUAGGCUCUGG >hsa-mir-326 MI0000808 (SEQ ID NO: 987)
CUCAUCUGUCUGUUGGGCUGGAGGCAGGGCCUUUGUGAAGGCGGGUGGUGCUCAGAUCGCCUCUGGGCCCUUCCUCC
AGCCCCGAGGCGGAUUCA >hsa-mir-328 MI0000804 (SEQ ID NO: 988)
UGGAGUGGGGGGCAGGAGGGGCUCAGGGAGAAAGUGCAUACAGCCCCUGGCCCUCUCUGCCCUUCCGUCCCCUG >hsa-mir-329-1 MI0001725 (SEQ ID NO: 989)
GGUACCUGAAGAGAGGUUUUCUGGGUUUCUGUUUCUUUAAUGAGGACGAAACACACCUGGUUAACCUCUUUUCCAGU
AUC >hsa-mir-329-2 MI0001726 (SEQ ID NO: 990)
GUGGUACCUGAAGAGAGGUUUUCUGGGUUUCUGUUUCUUUAUUGAGGACGAAACACACCUGGUUAACCUCUUUUCCA
GUAUCAA >hsa-mir-330 MI0000803 (SEQ ID NO: 991)
CUUUGGCGAUCACUGCCUCUCUGGGCCUGUGUCUUAGGCUCUGCAAGAUCAACCGAGCAAAGCACACGGCCUGCAGA
GAGGCAGCGCUCUGCCC >hsa-mir-331 MI0000812 (SEQ ID NO: 992)
GAGUUUGGUUUUGUUUGGGUUUGUUCUAGGUAUGGUCCCAGGGAUCCCAGAUCAAACCAGGCCCCUGGGCCUAUCCU
AGAACCAACCUAAGCUC >hsa-mir-335 MI0000816 (SEQ ID NO: 993)
UGUUUUGAGCGGGGGUCAAGAGCAAUAACGAAAAAUGUUUGUCAUAAACCGUUUUUCAUUAUUGCUCCUGACCUCCU
CUCAUUUGCUAUAUUCA >hsa-mir-337 MI0000806 (SEQ ID NO: 994)
GUAGUCAGUAGUUGGGGGUGGGAACGGCUUCAUACAGGAGUUGAUGCACAGUUAUCCAGCUCCUAUAUGAUGCCUU
UCUUCAUCCCCUUCAA >hsa-mir-338 MI0000814 (SEQ ID NO: 995)
UCCCAACAAUAUCCUGGUGCUGAGUGAUGACUCAGGCGACUCCAGCAUCAGUGAUUUUGUUGAAGA >hsa-mir-339 MI0000815 (SEQ ID NO: 996)
CGGGGCGGCCGCUCUCCCUGUCCUCCAGGAGCUCACGUGUGCCUGCCUGUGAGCGCCUCGACGACAGAGCCGGCGCC
UGCCCCAGUGUCUGCGC >hsa-mir-340 MI0000802 (SEQ ID NO: 997)
UUGUACCUGGUGUGAUUAUAAAGCAAUGAGACUGAUUGUCAUAUGUCGUUUGUGGGAUCCGUCUCAGUUACUUUAUA
GCCAUACCUGGUAUCUUA >hsa-mir-342 MI0000805 (SEQ ID NO: 998)
GAAACUGGGCUCAAGGUGAGGGGUGCUAUCUGUGAUUGAGGGACAUGGUUAAUGGAAUUGUCUCACACAGAAAUCGC
ACCCGUCACCUUGGCCUACUUA >hsa-mir-345 MI0000825 (SEQ ID NO: 999)
ACCCAAACCCUAGGUCUGCUGACUCCUAGUCCAGGGCUCGUGAUGGCUGGUGGGCCCUGAACGAGGGGUCUGGAGGC
CUGGGUUUGAAUAUCGACAGC >hsa-mir-346 MI0000826 (SEQ ID NO: 1000)
GGUCUCUGUGUUGGGCGUCUGUCUGCCCGCAUGCCUGCCUCUCUGUUGCUCUGAAGGAGGCAGGGGCUGGGCCUGCA
GCUGCCUGGGCAGAGCGG >hsa-mir-361 MI0000760 (SEQ ID NO: 1001)
GGAGCUUAUCAGAAUCUCCAGGGGUACUUUAUAAUUUCAAAAAGUCCCCCAGGUGUGAUUCUGAUUUGCUUC >hsa-mir-362 MI0000762 (SEQ ID NO: 1002)
CUUGAAUCCUUGGAACCUAGGUGUGAGUGCUAUUUCAGUGCAACACACCUAUUCAAGGAUUCAAA >hsa-mir-363 MI0000764 (SEQ ID NO: 1003)
UGUUGUCGGGUGGAUCACGAUGCAAUUUUGAUGAGUAUCAUAGGAGAAAAAUUGCACGGUAUCCAUCUGUAAACC >hsa-mir-365a MI0000767 (SEQ ID NO: 1004)
ACCGCAGGGAAAAUGAGGGACUUUUGGGGGCAGAUGUGUUUCCAUUCCACUAUCAUAAUGCCCCUAAAAAUCCUUAU
UGCUCUUGCA >hsa-mir-365b MI0000769 (SEQ ID NO: 1005)
AGAGUGUUCAAGGACAGCAAGAAAAAUGAGGGACUUUCAGGGGCAGCUGUGUUUUCUGACUCAGUCAUAAUGCCCCU
AAAAAUCCUUAUUGUUCUUGCAGUGUGCAUCGGG >hsa-mir-367 MI0000775 (SEQ ID NO: 1006)
CCAUUACUGUUGCUAAUAUGCAACUCUGUUGAAUAUAAAUUGGAAUUGCACUUUAGCAAUGGUGAUGG >hsa-mir-369 MI0000777 (SEQ ID NO: 1007)
UUGAAGGGAGAUCGACCGUGUUAUAUUCGCUUUAUUGACUUCGAAUAAUACAUGGUUGAUCUUUUCUCAG >hsa-mir-370 MI0000778 (SEQ ID NO: 1008)
AGACAGAGAAGCCAGGUCACGUCUCUGCAGUUACACAGCUCACGAGUGCCUGCUGGGGUGGAACCUGGUCUGUCU >hsa-mir-371a MI0000779 (SEQ ID NO: 1009)
GUGGCACUCAAACUGUGGGGGCACUUUCUGCUCUCUGGUGAAAGUGCCGCCAUCUUUUGAGUGUUAC >hsa-mir-371b MI0017393 (SEQ ID NO: 1010)
GGUAACACUCAAAAGAUGGCGGCACUUUCACCAGAGAGCAGAAAGUGCCCCCACAGUUUGAGUGCC >hsa-mir-372 MI0000780 (SEQ ID NO: 1011)
GUGGGCCUCAAAUGUGGAGCACUAUUCUGAUGUCCAAGUGGAAAGUGCUGCGACAUUUGAGCGUCAC >hsa-mir-373 MI0000781 (SEQ ID NO: 1012)
GGGAUACUCAAAAUGGGGGCGCUUUCCUUUUUGUCUGUACUGGGAAGUGCUUCGAUUUUGGGGUGUCCC >hsa-mir-374a MI0000782 (SEQ ID NO: 1013)
UACAUCGGCCAUUAUAAUACAACCUGAUAAGUGUUAUAGCACUUAUCAGAUUGUAUUGUAAUUGUCUGUGUA >hsa-mir-374b MI0005566 (SEQ ID NO: 1014)
ACUCGGAUGGAUAUAAUACAACCUGCUAAGUGUCCUAGCACUUAGCAGGUUGUAUUAUCAUUGUCCGUGUCU >hsa-mir-374c MI0016684 (SEQ ID NO: 1015)
ACACGGACAAUGAUAAUACAACCUGCUAAGUGCUAGGACACUUAGCAGGUUGUAUUAUAUCCAUCCGAGU >hsa-mir-375 MI0000783 (SEQ ID NO: 1016)
CCCCGCGACGAGCCCCUCGCACAAACCGGACCUGAGCGUUUUGUUCGUUCGGCUCGCGUGAGGC >hsa-mir-376a-1 MI0000784 (SEQ ID NO: 1017)
UAAAAGGUAGAUUCUCCUUCUAUGAGUACAUUAUUUAUGAUUAAUCAUAGAGGAAAAUCCACGUUUUC >hsa-mir-376a-2 MI0003529 (SEQ ID NO: 1018)
GGUAUUUAAAAGGUAGAUUUUCCUUCUAUGGUUACGUGUUUGAUGGUUAAUCAUAGAGGAAAAUCCACGUUUUCAGUAUC >hsa-mir-376b MI0002466 (SEQ ID NO: 1019)
CAGUCCUUCUUUGGUAUUUAAAACGUGGAUAUUCCUUCUAUGUUUACGUGAUUCCUGGUUAAUCAUAGAGGAAAAUCCAUGUUUUCAGUAUCAAAUGCUG >hsa-mir-376c MI0000776 (SEQ ID NO: 1020)
AAAAGGUGGAUAUUCCUUCUAUGUUUAUGUUAUUUAUGGUUAAACAUAGAGGAAAUUCCACGUUUU >hsa-mir-377 MI0000785 (SEQ ID NO: 1021)
UUGAGCAGAGGUUGCCCUUGGUGAAUUCGCUUUAUUUAUGUUGAAUCACACAAAGGCAACUUUUGUUUG >hsa-mir-378a MI0000786 (SEQ ID NO: 1022)
AGGGCUCCUGACUCCAGGUCCUGUGUGUUACCUAGAAAUAGCACUGGACUUGGAGUCAGAAGGCCU >hsa-mir-378b MI0014154 (SEQ ID NO: 1023)
GGUCAUUGAGUCUUCAAGGCUAGUGGAAAGAGCACUGGACUUGGAGGCAGAAAGACC >hsa-mir-378c MI0015825 (SEQ ID NO: 1024)
GGAGGCCAUCACUGGACUUGGAGUCAGAAGAGUGGAGUCGGGUCAGACUUCAACUCUGACUUUGAAGGUGGUGAGUGCCUC >hsa-mir-378d-1 MI0016749 (SEQ ID NO: 1025)
ACUGUUUCUGUCCUUGUUCUUGUUGUUAUUACUGGACUUGGAGUCAGAAACAGG >hsa-mir-378d-2 MI0003840 (SEQ ID NO: 1026)
GAAUGGUUACAAGGAGAGAACACUGGACUUGGAGUCAGAAAACUUUCAUCCAAGUCAUUCCCUGCUCUAAGUCCCAUUUCUGUUCCAUGAGAUUGUUU >hsa-mir-378e MI0016750 (SEQ ID NO: 1027)
CUGACUCCAGUGUCCAGGCCAGGGGCAGACAGUGGACAGAGAACAGUGCCCAAGACCACUGGACUUGGAGUCAGGACAU >hsa-mir-378f MI0016756 (SEQ ID NO: 1028)
GUCAGGUCCUGGACUCCCAUAGUUUUCAGGCUGCUAAACAACAGAACGAGCACUGGACUUGGAGCCAGAAGUCUUGGG >hsa-mir-378g MI0016761 (SEQ ID NO: 1029)
CACUGGGCUUGGAGUCAGAAGACCUGGCUCCAGCCCAGCUC >hsa-mir-378h MI0016808 (SEQ ID NO: 1030)
ACAGGAACACUGGACUUGGUGUCAGAUGGGAUGAGCCCUGGCUCUGUUUCCUAGCAGCAAUCUGAUCUUGAGCUAGUCACUGG >hsa-mir-378i MI0016902 (SEQ ID NO: 1031)
GGGAGCACUGGACUAGGAGUCAGAAGGUGGAGUUCUGGGUGCUGUUUUCCCACUCUUGGGCCCUGGGCAUGUUCUG >hsa-mir-379 MI0000787 (SEQ ID NO: 1032)
AGAGAUGGUAGACUAUGGAACGUAGGCGUUAUGAUUUCUGACCUAUGUAACAUGGUCCACUAACUCU >hsa-mir-380 MI0000788 (SEQ ID NO: 1033)
AAGAUGGUUGACCAUAGAACAUGCGCUAUCUCUGUGUCGUAUGUAAUAUGGUCCACAUCUU >hsa-mir-381 MI0000789 (SEQ ID NO: 1034)
UACUUAAAGCGAGGUUGCCCUUUGUAUAUUCGGUUUAUUGACAUGGAAUAUACAAGGGCAAGCUCUCUGUGAGUA >hsa-mir-382 MI0000790 (SEQ ID NO: 1035)
UACUUGAAGAGAAGUUGUUCGUGGUGGAUUCGCUUUACUUAUGACGAAUCAUUCACGGACAACACUUUUUUCAGUA >hsa-mir-383 MI0000791 (SEQ ID NO: 1036)
CUCCUCAGAUCAGAAGGUGAUUGUGGCUUUGGGUGGAUAUUAAUCAGCCACAGCACUGCCUGGUCAGAAAGAG >hsa-mir-384 MI0001145 (SEQ ID NO: 1037)
UGUUAAAUCAGGAAUUUUAAACAAUUCCUAGACAAUAUGUAUAAUGUUCAUAAGUCAUUCCUAGAAAUUGUUCAUAA
UGCCUGUAACA >hsa-mir-409 MI0001735 (SEQ ID NO: 1038)
UGGUACUCGGGGAGAGGUUACCCGAGCAACUUUGCAUCUGGACGACGAAUGUUGCUCGGUGAACCCCUUUUCGGUAU
CA >hsa-mir-410 MI0002465 (SEQ ID NO: 1039)
GGUACCUGAGAAGAGGUUGUCUGUGAUGAGUUCGCUUUUAUUAAUGACGAAUAUAACACAGAUGGCCUGUUUUCAGU
ACC >hsa-mir-411 MI0003675 (SEQ ID NO: 1040)
UGGUACUUGGAGAGAUAGUAGACCGUAUAGCGUACGCUUUAUCUGUGACGUAUGUAACACGGUCCACUAACCCUCAG
UAUCAAAUCCAUCCCCGAG >hsa-mir-412 MI0002464 (SEQ ID NO: 1041)
CUGGGGUACGGGGAUGGAUGGUCGACCAGUUGGAAAGUAAUUGUUUCUAAUGUACUUCACCUGGUCCACUAGCCGUC
CGUAUCCGCUGCAG >hsa-mir-421 MI0003685 (SEQ ID NO: 1042)
GCACAUUGUAGGCCUCAUUAAAUGUUUGUUGAAUGAAAAAAUGAAUCAUCAACAGACAUUAAUUGGGCGCCUGCUCU
GUGAUCUC >hsa-mir-422a MI0001444 (SEQ ID NO: 1043)
GAGAGAAGCACUGGACUUAGGGUCAGAAGGCCUGAGUCUCUCUGCUGCAGAUGGGCUCUCUGUCCCUGAGCCAAGCU
UUGUCCUCCCUGG >hsa-mir-423 MI0001445 (SEQ ID NO: 1044)
AUAAAGGAAGUUAGGCUGAGGGGCAGAGAGCGAGACUUUUCUAUUUUCCAAAAGCUCGGUCUGAGGCCCCUCAGUCU
UGCUUCCUAACCCGCGC >hsa-mir-424 MI0001446 (SEQ ID NO: 1045)
CGAGGGGAUACAGCAGCAAUUCAUGUUUUGAAGUGUUCUAAAUGGUUCAAAACGUGAGGCGCUGCUAUACCCCCUCG
UGGGGAAGGUAGAAGGUGGGG >hsa-mir-425 MI0001448 (SEQ ID NO: 1046)
GAAAGCGCUUUGGAAUGACACGAUCACUCCCGUUGAGUGGGCACCCGAGAAGCCAUCGGGAAUGUCGUGUCCGCCCA
GUGCUCUUUC >hsa-mir-429 MI0001641 (SEQ ID NO: 1047)
CGCCGGCCGAUGGGCGUCUUACCAGACAUGGUUAGACCUGGCCCUCUGUCUAAUACUGUCUGGUAAAACCGUCCAUC
CGCUGC >hsa-mir-431 MI0001721 (SEQ ID NO: 1048)
UCCUGCUUGUCCUGCGAGGUGUCUUGCAGGCCGUCAUGCAGGCCACACUGACGGUAACGUUGCAGGUCGUCUUGCAG
GGCUUCUCGCAAGACGACAUCCUCAUCACCAACGACG >hsa-mir-432 MI0003133 (SEQ ID NO: 1049)
UGACUCCUCCAGGUCUGGAGUAGGUCAUUGGGUGGAUCCUCUAUUUCCUUACGUGGGCCACUGGAUGGCUCCUCCA
UGUCUUGGAGUAGAUCA >hsa-mir-433 MI0001723 (SEQ ID NO: 1050)
CCGGGGAGAAGUACGGUGAGCCUGUCAUUAUUCAGAGAGGCUAGAUCCUCUGUGUUGAGAAGGAUCAUGAUGGGCUC
CUCGGUGUUCUCCAGG >hsa-mir-448 MI0001637 (SEQ ID NO: 1051)
GCCGGGAGGUUGAACAUCCUGCAUAGUGCUGCCAGGAAAUCCCUAUUUCAUAUAAGAGGGGGCUGGCUGGUUGCAUA
UGUAGGAUGUCCCAUCUCCCAGCCCACUUCGUCA >hsa-mir-449a MI0001648 (SEQ ID NO: 1052)
CUGUGUGUGAUGAGCUGGCAGUGUAUUGUUAGCUGGUUGAAUAUGUGAAUGGCAUCGGCUAACAUGCAACUGCUGUC
UUAUUGCAUAUACA >hsa-mir-449b MI0003673 (SEQ ID NO: 1053)
UGACCUGAAUCAGGUAGGCAGUGUAUUGUUAGCUGGCUGCUUGGGUCAAGUCAGCAGCCACAACUACCCUGCCACUU
GCUUCUGGAUAAAUUCUUCU >hsa-mir-449c MI0003823 (SEQ ID NO: 1054)
GCUGGGAUGUGUCAGGUAGGCAGUGUAUUGCUAGCGGCUGUUAAUGAUUUUAACAGUUGCUAGUUGCACUCCUCUCU
GUUGCAUUCAGAAGC >hsa-mir-450a-1 MI0001652 (SEQ ID NO: 1055)
AAACGAUACUAAACUGUUUUUGCGAUGUGUUCCUAAUAUGCACUAUAAAUAUAUUGGGAACAUUUUGCAUGUAUAGU
UUUGUAUCAAUAUA >hsa-mir-450a-2 MI0003187 (SEQ ID NO: 1056)
CCAAAGAAAGAUGCUAAACUAUUUUUGCGAUGUGUUCCUAAUAUGUAAUAUAAAUGUAUUGGGGACAUUUUGCAUUC
AUAGUUUUGUAUCAAUAAUAUGG >hsa-mir-450b MI0005531 (SEQ ID NO: 1057)
GCAGAAUUAUUUUUGCAAUAUGUUCCUGAAUAUGUAAUAUAAGUGUAUUGGGAUCAUUUUGCAUCCAUAGUUUUGUAU >hsa-mir-451a MI0001729 (SEQ ID NO: 1058)
CUUGGGAAUGGCAAGGAAACCGUUACCAUUACUGAGUUUAGUAAUGGUAAUGGUUCUCUUGCUAUACCCAGA >hsa-mir-451b MI0017360 (SEQ ID NO: 1059)
UGGGUAUAGCAAGAGAACCAUUACCAUUACUAAACUCAGUAAUGGUAACGGUUUCCUUGCCAUUCCCA >hsa-mir-452 MI0001733 (SEQ ID NO: 1060)
GCUAAGCACUUACAACUGUUUGCAGAGGAAACUGAGACUUUGUAACUAUGUCUCAGUCUCAUCUGCAAAGAAGUAAG
UGCUUUGC >hsa-mir-454 MI0003820 (SEQ ID NO: 1061)
UCUGUUUAUCACCAGAUCCUAGAACCCUAUCAAUAUUGUCUCUGCUGUGUAAAUAGUUCUGAGUAGUGCAAUAUUGC
UUAUAGGGUUUUGGUGUUUGGAAAGAACAAUGGGCAGG >hsa-mir-455 MI0003513 (SEQ ID NO: 1062)
UCCCUGGCGUGAGGGUAUGUGCCUUUGGACUACAUCGUGGAAGCCAGCACCAUGCAGUCCAUGGGCAUAUACACUUG
CCUCAAGGCCUAUGUCAUC >hsa-mir-466 MI0014157 (SEQ ID NO: 1063)
GUGUGUGUAUAUGUGUGUUGCAUGUGUGUAUAUGUGUGUAUAUAUGUACACAUACACAUACACGCAACACACAUAUA
UACAUGC >hsa-mir-483 MI0002467 (SEQ ID NO: 1064)
GAGGGGGAAGACGGGAGGAAAGAAGGGAGUGGUUCCAUCACGCCUCCUCACUCCUCUCCUCCCGUCUUCUCCUCUC >hsa-mir-484 MI0002468 (SEQ ID NO: 1065)
AGCCUCGUCAGGCUCAGUCCCCUCCCGAUAAACCCCUAAAUAGGGACUUUCCCGGGGGGUGACCCUGGCUUUUUGG
CG >hsa-mir-485 MI0002469 (SEQ ID NO: 1066)
ACUUGGAGAGAGGCUGGCCGUGAUGAAUUCGAUUCAUCAAAGCGAGUCAUACACGGCUCUCCUCUCUUUUAGU >hsa-mir-486 MI0002470 (SEQ ID NO: 1067)
GCAUCCUGUACUGAGCUGCCCCGAGGCCCUUCAUGCUGCCCAGCUCGGGGCAGCUCAGUACAGGAUAC >hsa-mir-487a MI0002471 (SEQ ID NO: 1068)
GGUACUUGAAGAGUGGUUAUCCCUGCUGUGUUCGCUUAAUUUAUGACGAAUCAUACAGGGACAUCCAGUUUUUCAGU
AUC >hsa-mir-487b MI0003530 (SEQ ID NO: 1069)
UUGUACUUGGAGAGUGGUUAUCCCUGUCCUGUUCGUUUUGCUCAUGUCGAAUCGUACAGGGUCAUCCACUUUUUCA
GUAUCAA >hsa-mir-488 MI0003123 (SEQ ID NO: 1070)
GAGAAUCAUCUCUCCCAGAUAAUGGCACUCUCAAACAAGUUUCCAAAUUGUUUGAAAGGCUAUUUCUUGGUCAGAUG
ACUCUC >hsa-mir-489 MI0003124 (SEQ ID NO: 1071)
GUGGCAGCUUGGUGGUCGUAUGUGUGACGCCAUUUACUUGAACCUUUAGGAGUGACAUCACAUAUACGGCAGCUAAA
CUGCUAC >hsa-mir-490 MI0003125 (SEQ ID NO: 1072)
UGGAGGCCUUGCUGGUUUGGAAAGUUCAUUGUUCGACACCAUGGAUCUCCAGGUGGGUCAAGUUUAGAGAUGCACCA
ACCUGGAGGACUCCAUGCUGUUGAGCUGUUCACAAGCAGCGGACACUUCCA >hsa-mir-491 MI0003126 (SEQ ID NO: 1073)
UUGACUUAGCUGGGUAGUGGGGAACCCUUCCAUGAGGAGUAGAACACUCCUUAUGCAAGAUUCCCUUCUACCUGGCU
GGGUUGG >hsa-mir-492 MI0003131 (SEQ ID NO: 1074)
CAACUACAGCCACUACUACAGGACCAUCGAGGACCUGCGGGACAAGAUUCUUGGUGCCACCAUUGAGAACGCCAGGA
UUGUCCUGCAGAUCAACAAUGCUCAACUGGCUGCAGAUG >hsa-mir-493 MI0003132 (SEQ ID NO: 1075)
CUGGCCUCCAGGGCUUUGUACAUGGUAGGCUUUCAUUCAUUCGUUUGCACAUUCGGUGAAGGUCUACUGUGUGCCAG
GCCCUGUGCCAG >hsa-mir-494 MI0003134 (SEQ ID NO: 1076)
GAUACUCGAAGGAGAGGUUGUCCGUGUUGUCUUCUCUUUAUUUAUGAUGAAACAUACACGGGAAACCUCUUUUUUAG
UAUC >hsa-mir-495 MI0003135 (SEQ ID NO: 1077)
UGGUACCUGAAAAGAAGUUGCCCAUGUUAUUUUCGCUUUAUAUGUGACGAAACAAACAUGGUGCACUUCUUUUUCGG
UAUCA >hsa-mir-496 MI0003136 (SEQ ID NO: 1078)
CCCAAGUCAGGUACUCGAAUGGAGGUUGUCCAUGGUGUGUUCAUUUUAUUUAUGAUGAGUAUUACAUGGCCAAUCUC
CUUUCGGUACUCAAUUCUUCUUGGG >hsa-mir-497 MI0003138 (SEQ ID NO: 1079)
CCACCCCGGUCCUGCUCCCGCCCCAGCAGCACACUGUGGUUUGUACGGCACUGUGGCCACGUCCAAACCACACUGUG
GUGUUAGAGCGAGGGUGGGGGAGGCACCGCCGAGG >hsa-mir-498 MI0003142 (SEQ ID NO: 1080)
AACCCUCCUUGGGAAGUGAAGCUCAGGCUGUGAUUUCAAGCCAGGGGGCGUUUUUCUAUAACUGGAUGAAAAGCACC
UCCAGAGCUUGAAGCUCACAGUUUGAGAGCAAUCGUCUAAGGAAGUU >hsa-mir-499a MI0003183 (SEQ ID NO: 1081)
GCCCUGUCCCCUGUGCCUUGGGCGGGCGGCUGUUAAGACUUGCAGUGAUGUUUAACUCCUCUCCACGUGAACAUCAC
AGCAAGUCUGUGCUGCUUCCCGUCCCUACGCUGCCUGGGCAGGGU >hsa-mir-499b MI0017396 (SEQ ID NO: 1082)
GGAAGCAGCACAGACUUGCUGUGAUGUUCACGUGGAGAGGAGUUAAACAUCACUGCAAGUCUUAACAGCCGCC >hsa-mir-500a MI0003184 (SEQ ID NO: 1083)
GCUCCCCCUCUCUAAUCCUUGCUACCUGGGUGAGAGUGCUGUCUGAAUGCAAUGCACCUGGGCAAGGAUUCUGAGAG
CGAGAGC >hsa-mir-500b MI0015903 (SEQ ID NO: 1084)
CCCCCUCUCUAAUCCUUGCUACCUGGGUGAGAGUGCUUUCUGAAUGCAGUGCACCCAGGCAAGGAUUCUGCAAGGGG
GA >hsa-mir-501 MI0003185 (SEQ ID NO: 1085)
GCUCUUCCUCUCUAAUCCUUUGUCCCUGGGUGAGAGUGCUUUCUGAAUGCAAUGCACCCGGGCAAGGAUUCUGAGAG
GGUGAGC >hsa-mir-502 MI0003186 (SEQ ID NO: 1086)
UGCUCCCCCUCUCUAAUCCUUGCUAUCUGGGUGCUAGUGCUGGCUCAAUGCAAUGCACCUGGGCAAGGAUUCAGAGA
GGGGGAGCU >hsa-mir-503 MI0003188 (SEQ ID NO: 1087)
UGCCCUAGCAGCGGGAACAGUUCUGCAGUGAGCGAUCGGUGCUCUGGGGUAUUGUUUCCGCUGCCAGGGUA >hsa-mir-504 MI0003189 (SEQ ID NO: 1088)
GCUGCUGUUGGGAGACCCUGGUCUGCACUCUAUCUGUAUUCUUACUGAAGGGAGUGCAGGGCAGGGUUUCCCAUACA
GAGGGC >hsa-mir-505 MI0003190 (SEQ ID NO: 1089)
GAUGCACCCAGUGGGGGAGCCAGGAAGUAUUGAUGUUUCUGCCAGUUUAGCGUCAACACUUGCUGGUUUCCUCUCUG
GAGCAUC >hsa-mir-506 MI0003193 (SEQ ID NO: 1090)
GCCACCACCAUCAGCCAUACUAUGUGUAGAUGCCUUAUUCAGGAAGGUGUUACUUAAUAGAUUAAUAUUUGUAAGGCA
CCCUUCUGAGUAGAGUAAUGUGCAACAUGGACAACAUUUGUGGUGGC >hsa-mir-507 MI0003194 (SEQ ID NO: 1091)
GUGCUGUGUGUAGUGCUUCACUUCAAGAAGUGCCAUGCAUGUGUCUAGAAAUAUGUUUUGCACCUUUUGGAGUGAAA
UAAUGCACAACAGAUAC >hsa-mir-508 MI0003195 (SEQ ID NO: 1092)
CCACCUUCAGCUGAGUGUAGUGCCCUACUCCAGAGGGCGUCACUCAUGUAAACUAAAACAUGAUUGUAGCCUUUUGG
AGUAGAGUAAUACACAUCACGUAACGCAUAUUUGGUGG >hsa-mir-509-1 MI0003196 (SEQ ID NO: 1093)
CAUGCUGUGUGUGGUACCCUACUGCAGACAGUGGCAAUCAUGUAUAAUUAAAAAUGAUUGGUACGUCUGUGGGUAGA
GUACUGCAUGACACAUG >hsa-mir-509-2 MI0005530 (SEQ ID NO: 1094)
CAUGCUGUGUGUGGUACCCUACUGCAGACAGUGGCAAUCAUGUAUAAUUAAAAAUGAUUGGUACGUCUGUGGGUAGA
GUACUGCAUGACAC >hsa-mir-509-3 MI0005717 (SEQ ID NO: 1095)
GUGGUACCCUACUGCAGACGUGGCAAUCAUGUAUAAUUAAAAAUGAUUGGUACGUCUGUGGGUAGAGUACUGCAU >hsa-mir-510 MI0003197 (SEQ ID NO: 1096)
GUGGUGUCCUACUCAGGAGAGUGGCAAUCACAUGUAAUUAGGUGUGAUUGAAACCUCUAAGAGUGGAGUAACAC >hsa-mir-511-1 MI0003127 (SEQ ID NO: 1097)
CAAUAGACACCCAUCGUGUCUUUUGCUCUGCAGUCAGUAAAUAUUUUUUUGUGAAUGUGUAGCAAAAGACAGAAUGG
UGGUCCAUUG >hsa-mir-511-2 MI0003128 (SEQ ID NO: 1098)
CAAUAGACACCCAUCGUGUCUUUUGCUCUGCAGUCAGUAAAUAUUUUUUUGUGAAUGUGUAGCAAAAGACAGAAUGG
UGGUCCAUUG >hsa-mir-512-1 MI0003140 (SEQ ID NO: 1099)
UCUCAGUCUGUGGCACUCAGCCUUGAGGGCACUUUCUGGUGCCAGAAUGAAAGUGCUGUCAUAGCUGAGGUCCAAUG
ACUGAGG >hsa-mir-512-2 MI0003141 (SEQ ID NO: 1100)
GGUACUUCUCAGUCUGUGGCACUCAGCCUUGAGGGCACUUUCUGGUGCCAGAAUGAAAGUGCUGUCAUAGCUGAGGU
CCAAUGACUGAGGCGAGCACC >hsa-mir-513a-1 MI0003191 (SEQ ID NO: 1101)
GGGAUGCCACAUUCAGCCAUUCAGCGUACAGUGCCUUUCACAGGGAGGUGUCAUUUAUGUGAACUAAAAUAUAAAUU
UCACCUUUCUGAGAAGGGUAAUGUACAGCAUGCACUGCAUAUGUGGUGUCCC >hsa-mir-513a-2 MI0003192 (SEQ ID NO: 1102)
GGAUGCCACAUUCAGCCAUUCAGUGUGCAGUGCCUUUCACAGGGAGGUGUCAUUUAUGUGAACUAAAAUAUAAAUUU
CACCUUUCUGAGAAGGGUAAUGUACAGCAUGCACUGCAUAUGUGGUGUCC >hsa-mir-513b MI0006648 (SEQ ID NO: 1103)
GUGUACAGUGCCUUUCACAAGGAGGUGUCAUUUAUGUGAACUAAAAUAUAAAUGUCACCUUUUGAGAGGAGUAAUG
UACAGCA >hsa-mir-513c MI0006649 (SEQ ID NO: 1104)
GCGUACAGUGCCUUUCUCAAGGAGGUGUCGUUUAUGUGAACUAAAAUAUAAAUUUCACCUUUCUGAGAAGAGUAAUG
UACAGCA >hsa-mir-514a-1 MI0003198 (SEQ ID NO: 1105)
AACAUGUUGUCUGUGGUACCCUACUCUGGAGAGUGACAAUCAUGUAUAAUUAAAUUUGAUUGACACUUCUGUGAGUA
GAGUAACGCAUGACACGUACG >hsa-mir-514a-2 MI0003199 (SEQ ID NO: 1106)
GUUGUCUGUGGUACCCUACUCUGGAGAGUGACAAUCAUGUAUAACUAAAUUUGAUUGACACUUCUGUGAGUAGAGUA
ACGCAUGACAC >hsa-mir-514a-3 MI0003200 (SEQ ID NO: 1107)
GUUGUCUGUGGUACCCUACUCUGGAGAGUGACAAUCAUGUAUAACUAAAUUUGAUUGACACUUCUGUGAGUAGAGUA
ACGCAUGACAC >hsa-mir-514b MI0014251 (SEQ ID NO: 1108)
CAUGUGGUACUCUUCUCAAGAGGGAGGCAAUCAUGUGUAAUUAGAUAUGAUUGACACCUCUGUGAGUGGAGUAACAC
AUG >hsa-mir-515-1 MI0003144 (SEQ ID NO: 1109)
UCUCAUGCAGUCAUUCUCCAAAAGAAAGCACUUUCUGUUGUCUGAAAGCAGAGUGCCUUCUUUUGGAGCGUUACUGU
UUGAGA >hsa-mir-515-2 MI0003147 (SEQ ID NO: 1110)
UCUCAUGCAGUCAUUCUCCAAAAGAAAGCACUUUCUGUUGUCUGAAAGCAGAGUGCCUUCUUUUGGAGCGUUACUGU
UUGAGA >hsa-mir-516a-1 MI0003180 (SEQ ID NO: 1111)
UCUCAGGCUGUGACCUUCUCGAGGAAAGAAGCACUUUCUGUUGUCUGAAAGAAAAGAAAGUGCUUCCUUUCAGAGGG
UUACGGUUUGAGA >hsa-mir-516a-2 MI0003181 (SEQ ID NO: 1112)
UCUCAGGUUGUGACCUUCUCGAGGAAAGAAGCACUUUCUGUUGUCUGAAAGAAAAGAAAGUGCUUCCUUUCAGAGGG
UUACGGUUUGAGA >hsa-mir-516b-1 MI0003172 (SEQ ID NO: 1113)
UCUCAGGCUGUGACCAUCUGGAGGUAAGAAGCACUUUCUGUUUUGUGAAAGAAAAGAAAGUGCUUCCUUUCAGAGGG
UUACUCUUUGAGA >hsa-mir-516b-2 MI0003167 (SEQ ID NO: 1114)
UCUCAUGAUGUGACCAUCUGGAGGUAAGAAGCACUUUGUGUUUUGUGAAAGAAAGUGCUUCCUUUCAGAGGGUUACU
CUUUGAGA >hsa-mir-517a MI0003161 (SEQ ID NO: 1115)
UCUCAGGCAGUGACCCUCUAGAUGGAAGCACUGUCUGUUGUAUAAAAGAAAAGAUCGUGCAUCCCUUUAGAGUGUUA
CUGUUUGAGA >hsa-mir-517b MI0003165 (SEQ ID NO: 1116)
GUGACCCUCUAGAUGGAAGCACUGUCUGUUGUCUAAGAAAAGAUCGUGCAUCCCUUUAGAGUGUUAC >hsa-mir-517c MI0003174 (SEQ ID NO: 1117)
GAAGAUCUCAGGCAGUGACCCUCUAGAUGGAAGCACUGUCUGUUGUCUAAGAAAAGAUCGUGCAUCCUUUUAGAGUG
UUACUGUUUGAGAAAAUC >hsa-mir-518a-1 MI0003170 (SEQ ID NO: 1118)
UCUCAAGCUGUGACUGCAAAGGGAAGCCCUUUCUGUUGUCUGAAAGAAGAGAAAGCGCUUCCCUUUGCUGGAUUACG
GUUUGAGA >hsa-mir-518a-2 MI0003173 (SEQ ID NO: 1119)
UCUCAAGCUGUGGGUCUGCAAAGGGAAGCCCUUUCUGUUGUCUAAAAGAAGAGAAAGCGCUUCCCUUUGCUGGAUUA
CGGUUUGAGA >hsa-mir-518b MI0003156 (SEQ ID NO: 1120)
UCAUGCUGUGGCCCUCCAGAGGGAAGCGCUUUCUGUUGUCUGAAAGAAAACAAAGCGCUCCCCUUUAGAGGUUUACG
GUUUGA >hsa-mir-518c MI0003159 (SEQ ID NO: 1121)
GCGAGAAGAUCUCAUGCUGUGACUCUCUGGAGGGAAGCACUUUCUGUUGUCUGAAAGAAAACAAAGCGCUUCUCUUU
AGAGUGUUACGGUUUGAGAAAAGC >hsa-mir-518d MI0003171 (SEQ ID NO: 1122)
UCCCAUGCUGUGACCCUCUAGAGGGAAGCACUUUCUGUUGUCUGAAAGAAACCAAAGCGCUUCCCUUUGGAGCGUUA
CGGUUUGAGA >hsa-mir-518e MI0003169 (SEQ ID NO: 1123)
UCUCAGGCUGUGACCCUCUAGAGGGAAGCGCUUUCUGUUGGCUAAAAGAAAAGAAAGCGCUUCCCUUCAGAGUGUUA
ACGCUUUGAGA >hsa-mir-518f MI0003154 (SEQ ID NO: 1124)
UCUCAUGCUGUGACCCUCUAGAGGGAAGCACUUUCUCUUGUCUAAAAGAAAAGAAAGCGCUUCUCUUUAGAGGAUUA
CUCUUUGAGA >hsa-mir-519a-1 MI0003178 (SEQ ID NO: 1125)
CUCAGGCUGUGACACUCUAGAGGGAAGCGCUUUCUGUUGUCUGAAAGAAAGGAAAGUGCAUCCUUUUAGAGUGUUAC
UGUUUGAG >hsa-mir-519a-2 MI0003182 (SEQ ID NO: 1126)
UCUCAGGCUGUGUCCCUCUACAGGGAAGCGCUUUCUGUUGUCUGAAAGAAAGGAAAGUGCAUCCUUUUAGAGUGUUA
CUGUUUGAGA >hsa-mir-519b MI0003151 (SEQ ID NO: 1127)
CAUGCUGUGACCCUCUAGAGGGAAGCGCUUUCUGUUGUCUGAAAGAAAAGAAAGUGCAUCCUUUUAGAGGUUUACUG
UUUG >hsa-mir-519c MI0003148 (SEQ ID NO: 1128)
UCUCAGCCUGUGACCCUCUAGAGGGAAGCGCUUUCUGUUGUCUGAAAGAAAAGAAAGUGCAUCUUUUUAGAGGAUUA
CAGUUUGAGA >hsa-mir-519d MI0003162 (SEQ ID NO: 1129)
UCCCAUGCUGUGACCCUCCAAAGGGAAGCGCUUUCUGUUUGUUUUCUCUUAAACAAAGUGCCUCCCUUUAGAGUGUU
ACCGUUUGGGA >hsa-mir-519e MI0003145 (SEQ ID NO: 1130)
UCUCAUGCAGUCAUUCUCCAAAAGGGAGCACUUUCUGUUUGAAAGAAAACAAAGUGCCUCCUUUUAGAGUGUUACUG
UUUGAGA >hsa-mir-520a MI0003149 (SEQ ID NO: 1131)
CUCAGGCUGUGACCCUCCAGAGGGAAGUACUUUCUGUUGUCUGAGAGAAAAGAAAGUGCUUCCCUUUGGACUGUUUC
GGUUUGAG >hsa-mir-520b MI0003155 (SEQ ID NO: 1132)
CCCUCUACAGGGAAGCGCUUUCUGUUGUCUGAAAGAAAAGAAAGUGCUUCCUUUUAGAGGG >hsa-mir-520c MI0003158 (SEQ ID NO: 1133)
UCUCAGGCUGUCGUCCUCUAGAGGGAAGCACUUUCUGUUGUCUGAAAGAAAAGAAAGUGCUUCCUUUUAGAGGGUUA
CCGUUUGAGA >hsa-mir-520d MI0003164 (SEQ ID NO: 1134)
UCUCAAGCUGUGAGUCUACAAAGGGAAGCCCUUUCUGUUGUCUAAAAGAAAAGAAAGUGCUUCUCUUUGGUGGGUUA
CGGUUUGAGA >hsa-mir-520e MI0003143 (SEQ ID NO: 1135)
UCUCCUGCUGUGACCCUCAAGAUGGAAGCAGUUUCUGUUGUCUGAAAGGAAAGAAAGUGCUUCCUUUUUGAGGGUUA
CUGUUUGAGA >hsa-mir-520f MI0003146 (SEQ ID NO: 1136)
UCUCAGGCUGUGACCCUCUAAAGGGAAGCGCUUUCUGUGGUCAGAAAGAAAAGCAAGUGCUUCCUUUUAGAGGGUUA
CCGUUUGGGA >hsa-mir-520g MI0003166 (SEQ ID NO: 1137)
UCCCAUGCUGUGACCCUCUAGAGGAAGCACUUUCUGUUUGUUGUCUGAGAAAAAACAAAGUGCUUCCCUUUAGAGUG
UUACCGUUUGGGA >hsa-mir-520h MI0003175 (SEQ ID NO: 1138)
UCCCAUGCUGUGACCCUCUAGAGGAAGCACUUUCUGUUUGUUGUCUGAGAAAAAACAAAGUGCUUCCCUUUAGAGUU
ACUGUUUGGGA >hsa-mir-521-1 MI0003176 (SEQ ID NO: 1139)
UCUCAGGCUGUGACCCUCCAAAGGGAAGAACUUUCUGUUGUCUAAAAGAAAAGAACGCACUUCCCUUUAGAGUGUUA
CCGUGUGAGA >hsa-mir-521-2 MI0003163 (SEQ ID NO: 1140)
UCUCGGGCUGUGACUCUCCAAAGGGAAGAAUUUUCUCUUGUCUAAAAGAAAAGAACGCACUUCCCUUUAGAGUGUUA
CCGUGUGAGA >hsa-mir-522 MI0003177 (SEQ ID NO: 1141)
UCUCAGGCUGUGUCCCUCUAGAGGGAAGCGCUUUCUGUUGUCUGAAAGAAAAGAAAUGGUUCCCUUUAGAGUGUUA
CGCUUUGAGA >hsa-mir-523 MI0003153 (SEQ ID NO: 1142)
UCUCAUGCUGUGACCCUCUAGAGGGAAGCGCUUUCUGUUGUCUGAAAGAAAAGAACGCGCUUCCCUAUAGAGGGUUA
CCCUUUGAGA >hsa-mir-524 MI0003160 (SEQ ID NO: 1143)
UCUCAUGCUGUGACCCUACAAAGGGAAGCACUUUCUCUUGUCCAAAGGAAAAGAAGGCGCUUCCCUUUGGAGUGUUA
CGGUUUGAGA >hsa-mir-525 MI0003152 (SEQ ID NO: 1144)
CUCAAGCUGUGACUCUCCAGAGGGAUGCACUUUCUCUUAUGUGAAAAAAAGAAGGCGCUUCCCUUUAGAGCGUUAC
GGUUUGGG >hsa-mir-526a-1 MI0003157 (SEQ ID NO: 1145)
CUCAGGCUGUGACCCUCUAGAGGGAAGCACUUUCUGUUGCUUGAAAGAAGAGAAAGCGCUUCCUUUUAGAGGAUUAC
UCUUUGAG >hsa-mir-526a-2 MI0003168 (SEQ ID NO: 1146)
GUGACCCUCUAGAGGGAAGCACUUUCUGUUGAAAGAAAAGAACAUGCAUCCUUUCAGAGGGUUAC >hsa-mir-526b MI0003150 (SEQ ID NO: 1147)
UCAGGCUGUGACCCUCUUGAGGGAAGCACUUUCUGUUGUCUGAAAGAAGAGAAAGUGCUUCCUUUUAGAGGCUUACU
GUCUGA >hsa-mir-527 MI0003179 (SEQ ID NO: 1148)
UCUCAAGCUGUGACUGCAAAGGGAAGCCCUUUCUGUUGUCUAAAAGAAAAGAAAGUGCUUCCCUUUGGUGAAUUACG
GUUUGAGA >hsa-mir-532 MI0003205 (SEQ ID NO: 1149)
CGACUUGCUUUCUCUCCUCCAUGCCUUGAGUGUAGGACCGUUGGCAUCUUAAUUACCCUCCCACACCCAAGGCUUGC
AAAAAAGCGAGCCU >hsa-mir-539 MI0003514 (SEQ ID NO: 1150)
AUACUUGAGGAGAAAUUAUCCUUGGUGUGUUCGCUUUAUUUAUGAUGAAUCAUACAAGGACAAUUUCUUUUUGAGUAU >hsa-mir-541 MI0005539 (SEQ ID NO: 1151)
ACGUCAGGGAAAGGAUUCUGCUGUCGGUCCCACUCCAAAGUUCACAGAAUGGGUGGUGGGCACAGAAUCUGGACUCU
GCUUGUG >hsa-mir-542 MI0003686 (SEQ ID NO: 1152)
CAGAUCUCAGACAUCUCGGGGAUCAUCAUGUCACGAGAUACCAGUGUGCACUUGUGACAGAUUGAUAACUGAAAGGU
CUGGGAGCCACUCAUCUUCA >hsa-mir-543 MI0005565 (SEQ ID NO: 1153)
UACUUAAUGAGAAGUUGCCCGUGUUUUUUUCGCUUUAUUUGUGACGAAACAUUCGCGGUGCACUUCUUUUUCAGUAUC >hsa-mir-544a MI0003515 (SEQ ID NO: 1154)
AUUUUCAUCACCUAGGGAUCUUGUUAAAAAGCAGAUUCUGAUUCAGGGACCAAGAUUCUGCAUUUUUAGCAAGUUCU
CAAGUGAUGCUAAU >hsa-mir-544b MI0014159 (SEQ ID NO: 1155)
GGAAUUUUGUUAAAAUGCAGAAUCCAUUUCUGUAGCUCUGAGACUAGACCUGAGGUUGUGCAUUUCUAACAAAGUGCC >hsa-mir-545 MI0003516 (SEQ ID NO: 1156)
CCCAGCCUGGCACAUUAGUAGGCCUCAGUAAAUGUUUAUUAGAUGAAUAAAUGAAUGACUCAUCAGCAAACAUUUAU
UGUGUGCCUGCUAAAGUGAGCUCCACAGG >hsa-mir-548a-1 MI0003593 (SEQ ID NO: 1157)
UGCAGGGAGGUAUUAAGUUGGUGCAAAAGUAAUUGUGAUUUUUGCCAUUAAAAGUAACGACAAAACUGGCAAUUACU
UUUGCACCAAACCUGGUAUU >hsa-mir-548a-2 MI0003598 (SEQ ID NO: 1158)
UGUGAUGUGUAUUAGGUUUGUGCAAAAGUAAUUGGGGUUUUUUGCCGUUAAAAGUAAUGGCAAAACUGGCAAUUACU
UUUGCACCAAACUAAUAUAA >hsa-mir-548a-3 MI0003612 (SEQ ID NO: 1159)
CCUAGAAUGUUAUUAGGUCGGUGCAAAAGUAAUUGCGAGUUUUACCAUUACUUUCAUGGCAAAACUGGCAAUUACU
UUUGCACCAACGUAAUACUU >hsa-mir-548aa-1 MI0016689 (SEQ ID NO: 1160)
CUUUAUUAGUCUGGUGCAAAAGAAACUGUGGUUUUUGCCAUUACUUUUACAGGCAAAAACCACAAUUACUUUUGCAC
CAACCUAAUAUAACUUGUUU >hsa-mir-548aa-2 MI0016690 (SEQ ID NO: 1161)
UUUUAUUAGGUUGGUGCAAAAGAAACUGUGGUUUUUGCCAUUACUUUCAUGGCAAAAACCACAAUUACUUUUGCAC
CAACCUAAAUCUUCCCUCUC >hsa-mir-548ab MI0016752 (SEQ ID NO: 1162)
AUGUUGGUGCAAAAGUAAUUGUGGAUUUUGCUAUUACUUGUAUUUAUUUGUAAUGCAAAACCCGCAAUUAGUUUUGC
ACCAACC >hsa-mir-548ac MI0016762 (SEQ ID NO: 1163)
GUAUUAGGUUGGUGCAAAAGUUAUUGUGGUUUUUGCUAUUUUUUUUAAUGGCAAAACCGGCAAUUACUUUUGCAC
UAACCUAGUAG >hsa-mir-548ad MI0016770 (SEQ ID NO: 1164)
CUGUUAGGUUGGUGCAAAAGUAAUUGUGGUUUUUGAAAGUAACUUGGCGAAAACGACAAUGACUUUUGCACCAAUCU
AAUAC >hsa-mir-548ae-1 MI0016779 (SEQ ID NO: 1165)
GCAGUUUUUGCCAUUAAGUUGCGGUUUUUGCCAUUAUAAUGGCAAAAACUGCAAUUACUUUCACACCUGC >hsa-mir-548ae-2 MI0016780 (SEQ ID NO: 1166)
UGUGCAAAAGUAAUUGUGGUUUUUGUCAUUUAAAAGUAAUGGCAAAAACUGCAAUUACUUUCACACC >hsa-mir-548ag-1 MI0016793 (SEQ ID NO: 1167)
GUGCAAAGGUAAUUGUGGUUUCUGCUUUUAAAGGUAAUGGCAAAUAUUACAUUUACUUUUGCACCA >hsa-mir-548ag-2 MI0016794 (SEQ ID NO: 1168)
UGCAAAGGUAAUUGUGGUUUCUGCCAUUGAAAGUAAAGGCAAGAACCUCAAUUACCUUUGCAGC >hsa-mir-548ah MI0016796 (SEQ ID NO: 1169)
AGGUUGGUGCAAAAGUGAUUGCAGUGUUUGCCAAUAAAGUAAUGACAAAAACUGCAGUUACUUUUGCACCAGCCC >hsa-mir-548ai MI0016813 (SEQ ID NO: 1170)
GUAUUAGGUUGGUGCAAAGGUAAUUGCAGUUUUUCCCAUUUAAAAUAUGGAAAAAAAAAUCACAAUUACUUUUGCAU
CAACCUAAUAA >hsa-mir-548aj-1 MI0016814 (SEQ ID NO: 1171)
AUUGGUGUAAAAGUAAUUGCAGGUUAUGCCAUUAAAAGUAAUGGUAAAAACUGCAAUUACUUUUACACUAAC >hsa-mir-548aj-2 MI0016815 (SEQ ID NO: 1172)
AAGGUAUUAGGUUGGUGCAAAAGUAAUUGCAGUUUUUGCUAUUACUUUUAAUGGUAAAAACUGCAAUUACUUUUACA
CCAACCUAAUAUUUA >hsa-mir-548ak MI0016840 (SEQ ID NO: 1173)
GUGCAAAAGUAACUGCGGUUUUUGAGAAGUAAUUGAAAACCGCAAUUACUUUUGCAG >hsa-mir-548al MI0016851 (SEQ ID NO: 1174)
GGUCGGUGCAAAAGUAAUUGCUGUUUUUUGCCAUUAAAAAUAAUGGCAUUAAAAGUAAUGGCAAAACGGCAAUGACU
UUUGUACCAAUCUAAUAUCU >hsa-mir-548am MI0016904 (SEQ ID NO: 1175)
AGUUGGUGCAAAAGUAAUUGCGGUUUUUUGCCGUCGAAAAUAAUGGCAAAAACUGCAGUUACUUUUGUACCAAUG >hsa-mir-548an MI0016907 (SEQ ID NO: 1176)
CAUUAGGUUGGUGCAAAAGGCAUUGUGGUUUUUUGCCUAUAAAAGUAAUGGCAAAAACCGCAAUUCCUUUUGCACCAA
CCUAAU >hsa-mir-548ao MI0017871 (SEQ ID NO: 1177)
AACUAUUCUUAGGUUGAUGCAGAAGUAACUACGGUUUUUGCAGUUGAAAGUAAUGGCAAAGACCGUGACUACUUUUG
CAACAGCCUAAUAGUUUCU >hsa-mir-548ap MI0017875 (SEQ ID NO: 1178)
ACCAAUUCCUAGGUUGGUGCAAAAGUAAUUGCGGUCUUUGUCAUUAAAACCAAUAACAAAAACCACAAUUACUUUUU
ACUGACCUAAAGAUUAAUU >hsa-mir-548aq MI0019130 (SEQ ID NO: 1179)
GAAAGUAAUUGCUGUUUUUGCCAUUACUUUCAGUGGCAAAAACUGCAAUUACUUUUGC >hsa-mir-548ar MI0019131 (SEQ ID NO: 1180)
AAAAGUAAUUGCAGUUUUUGCUGUUGAACGUAGUGGUAAAACUGCAGUUAUUUUUGC >hsa-mir-548as MI0019132 (SEQ ID NO: 1181)
AAAAGUAAUUGCGGGUUUUUGCCGUUGCUUUUAAUGGUAAAACCCACAAUUAUGUUUGU >hsa-mir-548at MI0019137 (SEQ ID NO: 1182)
AAAGUUAUUGCGGUUUUUGCUGCCAAAAGAAAUGGCCAAAACCGCAGUAACUUUUGU >hsa-mir-548au MI0019145 (SEQ ID NO: 1183)
AAAAGUAAUUGCGGUUUUUGCUAUUGGUUUUAAUGGCAGUUACUUUUGCACCAG >hsa-mir-548av MI0019152 (SEQ ID NO: 1184)
AAAAGUACUUGCGGAUUUGCCAUCACCUUUACCUUUAAUGGCAAAACUGCAGUUACUUUUGC >hsa-mir-548aw MI0019283 (SEQ ID NO: 1185)
UAGGUCGGUGCAAAAGUCAUCACGGUUUUUACCAUUAAAACCGCGAUGACUUUUGCAUCAACCUA >hsa-mir-548ax MI0019286 (SEQ ID NO: 1186)
GAUUGGUGCAGAAGUAAUUGCGGUUUUGCCAUGGAAAGUAAUGGCAAAAACCGUAAUUACUUUUGUACCAACC >hsa-mir-548b MI0003596 (SEQ ID NO: 1187)
CAGACUAUAUAUUUAGGUUGGCGCAAAAGUAAUUGUGGUUUUUGGCCUUUAUUUUCAAUGGCAAGAACCUCAGUUGCU
UUUGUGCCAACCUAAUACUU >hsa-mir-548c MI0003630 (SEQ ID NO: 1188)
CAUUGGCAUCUAUUAGGUUGGUGCAAAAGUAAUUGCGGUUUUUGCCAUUACUUUCAGUAGCAAAAAUCUCAAUUACU
UUUGCACCAACUUAAUACUU >hsa-mir-548d-1 MI0003668 (SEQ ID NO: 1189)
AAACAAGUUAUAUUAGGUUGGUGCAAAAGUAAUUGUGGUUUUUGCCUGUAAAAGUAAUGGCAAAAACCACAGUUUCU
UUUGCACCAGACUAAUAAAG >hsa-mir-548d-2 MI0003671 (SEQ ID NO: 1190)
GAGAGGGAAGAUUUAGGUUGGUGCAAAAGUAAUUGUGGUUUUUGCCAUUGAAAGUAAUGGCAAAAACCACAGUUUCU
UUUGCACCAACCUAAUAAAA >hsa-mir-548e MI0006344 (SEQ ID NO: 1191)
UUAUUAGGUUGGUACAAAAGCAAUCGCGGUUUUUGCUAUUACUUUUAAAGGCAAAAACUGAGACUACUUUUGCACCA
ACCUGAUAGAA >hsa-mir-548f-1 MI0006374 (SEQ ID NO: 1192)
AUUAGGUUGGUGCAAAAGUAAUCACAGUUUUUGACAUUACUUUCAAAGACAAAAACUGUAAUUACUUUUGGACCAAC
CUAAUAG >hsa-mir-548f-2 MI0006375 (SEQ ID NO: 1193)
UAAUAACUAUUAGGUUGGUGCGAACAUAAUUGCAGUUUUUAUCAUUACUUUUAAUGGCAAAAACUGUAAUUACUUUU
GCACCAACCUAAUAUUUAGU >hsa-mir-548f-3 MI0006376 (SEQ ID NO: 1194)
AUUAGGUUGGUGCAAACCUAAUUGCAAUUUUUGCAGUUUUUUUAAGUAAUUGCAAAAACUGUAAUUACUUUUGCACC
AACCUAAUAC >hsa-mir-548f-4 MI0006377 (SEQ ID NO: 1195)
GAGUUCUAACGUAUUAGGUUGGUGCAAAAGUAAUAGUGGUUUUUGCCAUUAAAAGUAAUGACAAAAACUGUAAUUAC
UUUUGGAACAAUAUUAAUAGAAUUUCAG >hsa-mir-548f-5 MI0006378 (SEQ ID NO: 1196)
UAUUAGGUUGCUGCAAAAGUAAUCAUGUUUUUUUCCAUUGUAAGUAAUGGGAAAAACUGUAAUUACUUUUGUACCAA
CCUAAUAGC >hsa-mir-548g MI0006395 (SEQ ID NO: 1197)
AGUUAUUAGAUUAGUGCAAAAGUAAUUGCAGUUUUUGCAUUACGUUCUAUGGCAAAACUGUAAUUACUUUUGUACCA
ACAUAAUACUUC >hsa-mir-548h-1 MI0006411 (SEQ ID NO: 1198)
UCUGUCCAUUAGGUGGGUGCAAAAGUAAUCGCGGUUUUUGUCAUUACUUUUAAUGGUAAAAACUGGAAUUACUUUUG
CACUGACCUAAUAUUAAGCCAGAUA >hsa-mir-548h-2 MI0006412 (SEQ ID NO: 1199)
GUAUUAGGUUGGUGCAAAAGUAAUCGCGGUUUUUGUCAUUACUUUCAAUGGCAAACACCACAAUUACUUUUGCACCA
ACCUAAUAUAA >hsa-mir-548h-3 MI0006413 (SEQ ID NO: 1200)
UCUGAUUCUGCAUGUAUUAGGUUGGUGCAAAAGUAAUCGCGGUUUUUGUCAUUGAAAGUAAUAGCAAAAACUGCAAU
UACUUUUGCACCAACCUAAAAGUAGUCACUGUCUUCAGAUA >hsa-mir-548h-4 MI0006414 (SEQ ID NO: 1201)
GCUAUUAGGUUGGUGCAAAAGUAAUCGCGGUUUUUGUCAUUACUUUAAUUACUUUACGUUUCAUUAAUGACAAAAC
CGCAAUUACUUUUGCACCAACCUAAUACUUGCUA >hsa-mir-548h-5 MI0016751 (SEQ ID NO: 1202)
ACAAAAGUAAUCGCGGUUUUUGUCAUUACUUUUAACUGUAAAAACCACGGUUGCUUUUGC >hsa-mir-548i-1 MI0006421 (SEQ ID NO: 1203)
CAGAUGGCUCUGAAGUUUGCACCCUAUUAGGUUGGUGCAAAAGUAAUUGCGGAUUUUGCCAUUAAAAGUAAUGGCAA
AAAUAGCAAUUAUUUUUGUACCAGCCUAGUAUCUUUUCUCCUUCUACCAAACUUUGUCCCUGAGCCAUCUCA >hsa-mir-548i-2 MI0006422 (SEQ ID NO: 1204)
UAGAUGGCUCCGAAGUUUGCAUCCUAUUAGUUUGGUGCAAAAGUAAUUGCGGAUUUUGCCAUUAAAAGUAAUGGCAA
AAAUAGCAAUUAUUUUUGUACCAGCCUAGUAUCUUUUCUCCUUCUAACAAAGUUCGUCCCUGAUCCAUCUCA >hsa-mir-548i-3 MI0006423 (SEQ ID NO: 1205)
CAGAUGGCUCCGAAGUUUACAUCCUAUUAGGUUUGUGCAAAAGUAAUUGCGGAUUUUGCCAUUAAAAGUAAUGGCAA
AAAUAGCAAUUAUUUUUGUACCAGCCUAGUAUCUUUUCUCCUUCUACCAAACUUUGUCCCUGAGCCAUCUCA >hsa-mir-548i-4 MI0006424 (SEQ ID NO: 1206)
AGGUUGGUGCAAAAGUAAUUGCGGAUUUUGCCAUACUUUUAACGGCAAAAACCACAAAUAUUAUUGCACCAACCUAU >hsa-mir-548j MI0006345 (SEQ ID NO: 1207)
GGGCAGCCAGUGAAUAGUUAGCUGGUGCAAAAGUAAUUGCGGUCUUUGGUAUUACUUUCAGUGGCAAAAACUGCAUU
ACUUUUGCACCAGCCUACUAGAACGCUGAGUUCAG >hsa-mir-548k MI0006354 (SEQ ID NO: 1208)
CUUUUCUCAAGUAUUGCUGUUAGGUUGGUGCAAAAGUACUUGCGGAUUUUGCUUUACUUUUAAUGGCAAAAACCGCA
AUUAUUUUUGCUUCAACCUAAUAUGAUGCAAAAUUGGCU >hsa-mir-548l MI0006361 (SEQ ID NO: 1209)
UAUUAGGUUGGUGCAAAAGUAUUUGCGGGUUUUUGUCGUAGAAAGUAAUGGCAAAAACUGCAGUUACUUGUGCACCAA
CCAAAUGCU >hsa-mir-548m MI0006400 (SEQ ID NO: 1210)
AUAUUAGGUUGGUGCAAAGGUAUUUGUGGUUUUUGUCAUUAAAGUAAUGCAAAAGCCACAAAUACCUUUGCACCAAC
CUAAUAUUA >hsa-mir-548n MI0006399 (SEQ ID NO: 1211)
AGGUUGGUGCAAAAGUAAUUGUGGAUUUUGUCGUUAAAAAUAGCAAAACCCGCAAUUACUUUUGCACCAACCUAA >hsa-mir-548o MI0006402 (SEQ ID NO: 1212)
UGGUGAAAAUGUGUUGAUUGUAAUGGUUCCUAUUCUGAUCAAUAAACAUGGUUUUGAGCCUAGUUACAAUGAUCUAAA
AUUCACGGUCCAAAACUGCAGUUACUUUUGCACCAAC >hsa-mir-548o-2 MI0016746 (SEQ ID NO: 1213)
UGGUGCAAAAGUAAUUGCGGUUUUUGCCAUUAAAAGUAAUGCGGCCAAAACUGCAGUUACUUUUGCACCC >hsa-mir-548p MI0006420 (SEQ ID NO: 1214)
AUUAGGUUGGUAUAAAAUUAAUUGCAGUUUUUGUCAUUACUUUCAAUAGCAAAAACUGCAGUUACUUUUGCACCAAU
GUAAUAC >hsa-mir-548q MI0010637 (SEQ ID NO: 1215)
AUAUUAGGCUGGUGCAAAAGUAAUGGCGGUUUUUGCCAUUACUUUUCAUUUUUACCAUUAAAAGUAAUGGCAAAAAG
CAUGAUUACUUUUUCACCAACCU >hsa-mir-548s MI0014141 (SEQ ID NO: 1216)
UUGCUGCAAAAAUAAUUGCAGUUUUUGCCAUUAUUUUUAAUAAUUAUAAUAAUGGCCAAAACUGCAGUUAUUUUUGC
ACCAA >hsa-mir-548t MI0014164 (SEQ ID NO: 1217)
AGGGUGGUGCAAAAGUGAUCGUGGUUUUUGCAAUUUUUUAAUGACAAAAACCACAAUUACUUUUGCACCAACCU >hsa-mir-548u MI0014168 (SEQ ID NO: 1218)
AUUAGGAUGGUGCAAAAGUAAUGUGGUUUUUUUCUUUACUUUUAAUGGCAAAGACUGCAAUUACUUUUGCGCCAACC
UAAU >hsa-mir-548v MI0014174 (SEQ ID NO: 1219)
AAUACUAGGUUUGAGCAAAAGUAAUUGCGGUUUUUGCCAUCAUGCCAAAAGCUACAGUUACUUUUGCACCAGCCUAAU
AUU >hsa-mir-548w MI0014222 (SEQ ID NO: 1220)
GGUUGGUGCAAAAGUAACUGCGGUUUUUGCCUUUCAACAUAAUGGCAAAACCCACAAUUACUUUUGCACCAAUC >hsa-mir-548x MI0014244 (SEQ ID NO: 1221)
AGGUUAGUGCAAAAGUAAUUGCAGUUUUUGCGUUACUUUCAAUCGUAAAAACUGCAAUUACUUUCACACCAAUCU >hsa-mir-548x-2 MI0016833 (SEQ ID NO: 1222)
AUGCCAAAUAUUAGGUUGGCACAAAAGUAAUUGUGGCUUUUGCCAUUAAAAGUAAUGGUAAAAACUGCAAUUACUUU
CGUGCCAACCUAAUAUUUGUGUG >hsa-mir-548y MI0016595 (SEQ ID NO: 1223)
GCCUAAACUAUUAGGUUGGUGCAAAAGUAAUCACUGUUUUUGCCAUUACUCUCAGUGGCAAAAACCGUGAUUACUUU
UGCACCAACCUAGUAACACCUUCACUGUGGGGG >hsa-mir-548z MI0016688 (SEQ ID NO: 1224)
AAGUAUUAAGUUGGUGCAAAAGUAAUUGAGAUUUUUGCUACUGAAAGUAAUGGCAAAAACCGCAAUUACUUUUGCAC
CAACCUAAUAGAUGCCAAUG >hsa-mir-549 MI0003679 (SEQ ID NO: 1225)
AGACAUGCAACUCAAGAAUAUAUUGAGAGCUCAUCCAUAGUUGUCACUGUCUCAAAUCAGUGACAACUAUGGAUGAG
CUCUUAAUAUAUCCCAGGC >hsa-mir-550a-1 MI0003600 (SEQ ID NO: 1226)
UGAUGCUUUGCUGGCUGGUGCAGUGCCUGAGGGAGUAAGAGCCCUGUUGUUGUAAGAUAGUGUCUUACUCCCUCAGG
CACAUCUCCAACAAGUCUCU >hsa-mir-550a-2 MI0003601 (SEQ ID NO: 1227)
UGAUGCUUUGCUGGCUGGUGCAGUGCCUGAGGGAGUAAGAGCCCUGUUGUUGUCAGAUAGUGUCUUACUCCCUCAGG
CACAUCUCCAGCGAGUCUCU >hsa-mir-550a-3 MI0003762 (SEQ ID NO: 1228)
GAUGCUUUGCUGGCUGGUGCAGUGCCUGAGGGAGUAAGAGUCCUGUUGUUGUAAGAUAGUGUCUUACUCCCUCAGGC
ACAUCUCCAACAAGUCUC >hsa-mir-550b-1 MI0016686 (SEQ ID NO: 1229)
AGAGACUUGUUGGAGAUGUGCCUGAGGGAGUAAGACACUAUCUUACAACAACAGGGCUCUUACUCCCUCAGGCACUG
CACCAGCCAGCAAAGCAUCA >hsa-mir-550b-2 MI0016687 (SEQ ID NO: 1230)
AGAGACUCGCUGGAGAUGUGCCUGAGGGAGUAAGACACUAUCUGACAACAACAGGGCUCUUACUCCCUCAGGCACUG
CACCAGCCAGCAAAGCAUCA >hsa-mir-551a MI0003556 (SEQ ID NO: 1231)
GGGGACUGCCGGGUGACCCUGGAAAUCCAGAGUGGGUGGGGCCAGUCUGACCGUUUCUAGGCGACCCACUCUUGGUU
UCCAGGGUUGCCCUGGAAA >hsa-mir-551b MI0003575 (SEQ ID NO: 1232)
AGAUGUGCUCUCCUGGCCCAUGAAAUCAAGCGUGGGUGAGACCUGGUGCAGAACGGGAAGGCGACCCAUACUUGGUU
UCAGAGGCUGUGAGAAUAA >hsa-mir-552 MI0003557 (SEQ ID NO: 1233)
AACCAUUCAAAUAUACCACAGUUUGUUUAACCUUUUGCCUGUUGGUUGAAGAUGCCUUUCAACAGGUGACUGGUUAG
ACAAACUGUGGUAUAUACA >hsa-mir-553 MI0003558 (SEQ ID NO: 1234)
CUUCAAUUUUAUUUUAAAACGGUGAGAUUUUGUUUUGUCUGAGAAAAUCUCGCUGUUUUAGACUGAGG >hsa-mir-554 MI0003559 (SEQ ID NO: 1235)
ACCUGAGUAACCUUUGCUAGUCCUGACUCAGCCAGUACUGGUCUUAGACUGGUGAUGGGUCAGGGUUCAUAUUUGG
CAUCUCUCUCUGGGCAUCU >hsa-mir-555 MI0003561 (SEQ ID NO: 1236)
GGAGUGAACUCAGAUGUGGAGCACUACCUUUGUGAGCAGUGACCCAAGGCCUGUGGACAGGGUAAGCUGAACCUC
UGAUAAAACUCUGAUCUAU >hsa-mir-556 MI0003562 (SEQ ID NO: 1237)
GAUAGUAAUAAGAAAGAUGAGCUCAUUGUAAUAUGAGCUUCAUUUAUACAUUUCAUAUUACCAUUAGCUCAUCUUUU
UUAUUACUACCUUCAACA >hsa-mir-557 MI0003563 (SEQ ID NO: 1238)
AGAAUGGGCAAAUGAACAGUAAAUUUUGGAGGCCUGGGGCCCUCCCUGCUGCUGGAGAAGUGUUUGCACGGGUGGGCC
UUGUCUUUGAAAGGAGGUGGA >hsa-mir-558 MI0003564 (SEQ ID NO: 1239)
GUGUGUGUGUGUGUGGUUAUUUUGGUAUAGUAGCUCUAGACUCUAUUAUAGUUUCCUGAGCUGCUGUACCAAA
AUACCACAAACGGGCUG >hsa-mir-559 MI0003565 (SEQ ID NO: 1240)
GCUCCAGUAACAUCUUAAAGUAAAUAUGCACCAAAAUUACUUUUGGUAAAUACAGUUUUGGUGCAUAUUUACUUUAG
GAUGUUACUGGAGCUCCCA -continued >hsa-mir-561 MI0003567 (SEQ ID NO: 1241)
CUUCAUCCACCAGUCCUCCAGGAACAUCAAGGAUCUUAAACUUUGCCAGAGCUACAAAGGCAAAGUUUAAGAUCCUU
GAAGUUCCUGGGGGAACCAU >hsa-mir-562 MI0003568 (SEQ ID NO: 1242)
AGUGAAAUUGCUAGGUCAUAUGGUCAGUCUACUUUUAGAGUAAUUGUGAAACUGUUUUUCAAAGUAGCUGUACCAUU
UGCACUCCCUGUGGCAAU >hsa-mir-563 MI0003569 (SEQ ID NO: 1243)
AGCAAAGAAGUGUGUUGCCCUCUAGGAAAUGUGUGUUGCUCUGAUGUAAUUAGGUUGACAUACGUUUCCCUGGUAGC
CA >hsa-mir-564 MI0003570 (SEQ ID NO: 1244)
CGGGCAGCGGGUGCCAGGCACGGUGUCAGCAGGCAACAUGGCCGAGAGGCCGGGGCCUCCGGGCGGCGCCGUGUCCG
CGACCGCGUACCCUGAC >hsa-mir-566 MI0003572 (SEQ ID NO: 1245)
GCUAGGCGUGGUGGCGGGCGCCUGUGAUCCCAACUACUCAGGAGGCUGGGGCAGCAGAAUCGCUUGAACCCGGGAGG
CGAAGGUUGCAGUGAGC >hsa-mir-567 MI0003573 (SEQ ID NO: 1246)
GGAUUCUUAUAGGACAGUAUGUUCUUCCAGGACAGAACAUUCUUUGCUAUUUUGUACUGGAAGAACAUGCAAAACUA
AAAAAAAAAAAGUUAUUGCU >hsa-mir-568 MI0003574 (SEQ ID NO: 1247)
GAUAUACACUAUAUUAUGUAUAAAUGUAUACACACUUCCUAUAUGUAUCCACAUAUAUAUAGUGUAUAUAUUAUACA
UGUAUAGGUGUGUAUAUG >hsa-mir-569 MI0003576 (SEQ ID NO: 1248)
GGUAUUGUUAGAUUAAUUUUGUGGGACAUUAACAACAGCAUCAGAAGCAACAUCAGCUUUAGUUAAUGAAUCCUGGA
AAGUUAAGUGACUUUAUUU >hsa-mir-570 MI0003577 (SEQ ID NO: 1249)
CUAGAUAAGUUAUUAGGUGGGUGCAAAGGUAAUUGCAGUUUUUCCCAUUAUUUUAAUUGCGAAAACAGCAAUUACCU
UUGCACCAACCUGAUGGAGU >hsa-mir-571 MI0003578 (SEQ ID NO: 1250)
CCUCAGUAAGACCAAGCUCAGUGUGCCAUUUCCUUGUCUGUAGCCAUGUCUAUGGGCUCUUGAGUUGGCCAUCUGAG
UGAGGGCCUGCUUAUUCUA >hsa-mir-572 MI0003579 (SEQ ID NO: 1251)
GUCGAGGCCGUGGCCCGGAAGUGGUCGGGGCCGCUGCGGGCGGAAGGGCGCCUGUGCUUCGUCCGCUCGGCGGUGGC
CCAGCCAGGCCCGCGGGA >hsa-mir-573 MI0003580 (SEQ ID NO: 1252)
UUUAGCGGUUUCUCCCUGAAGUGAUGUGUAACUGAUCAGGAUCUACUCAUGUCGUCUUUGGUAAAGUUAUGUCGCUU
GUCAGGGUGAGGAGAGUUUUUG >hsa-mir-574 MI0003581 (SEQ ID NO: 1253)
GGGACCUGCGUGGGUGCGGGCGUGUGAGUGUGUGUGUGUGAGUGUGUGUCGCUCCGGGUCCACGCUCAUGCACACAC
CCACACGCCCACACUCAGG >hsa-mir-575 MI0003582 (SEQ ID NO: 1254)
AAUUCAGCCCUGCCACUGGCUUAUGUCAUGACCUUGGGCUACUCAGGCUGUCUGCACAAUGAGCCAGUUGGACAGGA
GCAGUGCCACUCAACUC >hsa-mir-576 MI0003583 (SEQ ID NO: 1255)
UACAAUCCAACGAGGAUUCUAAUUUCUCCACGUCUUUGGUAAUAAGGUUUGGCAAAGAUGUGGAAAAAUUGGAAUCC
UCAUUCGAUUGGUUAUAACCA >hsa-mir-577 MI0003584 (SEQ ID NO: 1256)
UGGGGGAGUGAAGAGUAGAUAAAAUAUUGGUACCUGAUGAAUCUGAGGCCAGGUUUCAAUACUUUAUCUGCUCUUCA
UUUCCCCAUAUCUACUUAC >hsa-mir-578 MI0003585 (SEQ ID NO: 1257)
AGAUAAAUCUAUAGACAAAAUACAAUCCCGGACAACAAGAAGCUCCUAUAGCUCCUGUAGCUUCUUGUGCUCUAGGA
UUGUAUUUUGUUUAUAUAU >hsa-mir-579 MI0003586 (SEQ ID NO: 1258)
CAUAUUAGGUUAAUGCAAAAGUAAUCGCGGUUUGUGCCAGAUGACGAUUUGAAUUAAUAAAUUCAUUUGGUAUAAAC
CGCGAUUAUUUUUGCAUCAAC >hsa-mir-580 MI0003587 (SEQ ID NO: 1259)
AUAAAAUUUCCAAUUGGAACCUAAUGAUUCAUCAGACUCAGAUAUUUAAGUUAACAGUAUUUGAGAAUGAUGAAUCA
UUAGGUUCCGGUCAGAAAUU >hsa-mir-581 MI0003588 (SEQ ID NO: 1260)
GUUAUGUGAAGGUAUUCUUGUGUUCUCUAGAUCAGUGCUUUUAGAAAAUUUGUGUGAUCUAAAGAACACAAAGAAUA
CCUACACAGAACCACCUGC >hsa-mir-582 MI0003589 (SEQ ID NO: 1261)
AUCUGUGCUCUUUGAUUACAGUUGUUCAACCAGUUACUAAUCUAACUAAUUGUAACUGGUUGAACAACUGAACCCAA
AGGGUGCAAAGUAGAAACAUU >hsa-mir-583 MI0003590 (SEQ ID NO: 1262)
AACUCACACAUUAACCAAAGAGGAAGGUCCCAUUACUGCAGGGAUCUUAGCAGUACUGGGACCUACCUCUUUGGU >hsa-mir-584 MI0003591 (SEQ ID NO: 1263)
UAGGGUGACCAGCCAUUAUGGUUUGCCUGGGACUGAGGAAUUUGCUGGGAUAUGUCAGUUCCAGGCCAACCAGGCUG
GUUGGUCUCCCUGAAGCAAC >hsa-mir-585 MI0003592 (SEQ ID NO: 1264)
UGGGGUGUCUGUGCUAUGGCAGCCCUAGCACACAGAUACGCCCAGAGAAAGCCUGAACGUUGGGCGUAUCUGUAUGC
UAGGGCUGCUGUAACAA >hsa-mir-586 MI0003594 (SEQ ID NO: 1265)
AUGGGGUAAAACCAUUAUGCAUUGUAUUUUUAGGUCCCAAUACAUGUGGGCCCUAAAAAUACAAUGCAUAAUGGUUU
UUCACUCUUUAUCUUCUUAU >hsa-mir-587 MI0003595 (SEQ ID NO: 1266)
CUCCUAUGCACCCUCUUUCCAUAGGUGAUGAGUCACAGGGCUCAGGGAAUGUGUCUGCACCUGUGACUCAUCACCAG
UGGAAAGCCCAUCCCAUAU >hsa-mir-588 MI0003597 (SEQ ID NO: 1267)
AGCUUAGGUACCAAUUUGGCCACAAUGGGUUAGAACACUAUUCCAUUGUGUUCUUACCCACCAUGGCCAAAAUUGGG
CCUAAG >hsa-mir-589 MI0003599 (SEQ ID NO: 1268)
UCCAGCCUGUGCCCAGCAGCCCCUGAGAACCACGUCUGCUCUGAGCUGGGUACUGCCUGUUCAGAACAAAUGCCGGU
UCCCAGACGCUGCCAGCUGGCC >hsa-mir-590 MI0003602 (SEQ ID NO: 1269)
UAGCCAGUCAGAAAUGAGCUUAUUCAUAAAAGUGCAGUAUGGUGAAGUCAAUCUGUAAUUUUAUGUAUAAGCUAGUC
UCUGAUUGAAACAUGCAGCA >hsa-mir-591 MI0003603 (SEQ ID NO: 1270)
UCUUAUCAAUGAGGUAGACCAUGGGUUCUCAUUGUAAUAGUGUAGAAUGUUGGUUAACUGUGGACUCCCUGGCUCUG
UCUCAAAUCUACUGAUUC >hsa-mir-592 MI0003604 (SEQ ID NO: 1271)
UAUUAUGCCAUGACAUUGUGUCAAUAUGCGAUGAUGUGUUGUGAUGGCACAGCGUCAUCACGUGGUGACGCAACAUC
AUGACGUAAGACGUCACAAC >hsa-mir-593 MI0003605 (SEQ ID NO: 1272)
CCCCCAGAAUCUGUCAGGCACCAGCCAGGCAUUGCUCAGCCCGUUUCCCUCUGGGGGAGCAAGGAGUGGUGCUGGGU
UUGUCUCUGCUGGGGUUUCUCCU >hsa-mir-595 MI0003607 (SEQ ID NO: 1273)
ACGGAAGCCUGCACGCAUUUAACACCAGCACGCUCAAUGUAGUCUUGUAAGGAACAGGUUGAAGUGUGCCGUGGUGU
GUCUGGAGGAAGCGCCUGU >hsa-mir-596 MI0003608 (SEQ ID NO: 1274)
AGCACGGCCUCUCCGAAGCCUGCCCGGCUCCUCGGGAACCUGCCUCCCGCAUGGCAGCUGCUGCCCUUCGGAGGCCG >hsa-mir-597 MI0003609 (SEQ ID NO: 1275)
UACUUACUCUACGUGUGUGUCACUCGAUGACCACUGUGAAGACAGUAAAAUGUACAGUGGUUCUCUUGUGGCUCAAG
CGUAAUGUAGAGUACUGGUC >hsa-mir-598 MI0003610 (SEQ ID NO: 1276)
GCUUGAUGAUGCUGCUGAUGCUGGCGGUGAUCCCGAUGGUGUGAGCUGGAAAUGGGGUGCUACGUCAUCGUUGUCAU
CGUCAUCAUCAUCCGAG >hsa-mir-599 MI0003611 (SEQ ID NO: 1277)
AAAGACAUGCUGUCCACAGUGUGUUUGAUAAGCUGACAUGGGACAGGGAUUCUUUUCACUGUUGUGUCAGUUUAUCA
AACCCAUACUUGGAUGAC >hsa-mir-600 MI0003613 (SEQ ID NO: 1278)
AAGUCACGUGCUGUGGCUCCAGCUUCAUAGGAAGGCUCUUGUCUGUCAGGCAGUGGAGUUACUUACAGACAAGAGCC
UUGCUCAGGCCAGCCCUGCCC >hsa-mir-601 MI0003614 (SEQ ID NO: 1279)
UGCAUGAGUUCGUCUUGGUCUAGGAUUGUUGGAGGAGUCAGAAAAACUACCCCAGGGAUCCUGAAGUCCUUUGGGUG
GA >hsa-mir-602 MI0003615 (SEQ ID NO: 1280)
UUCUCACCCCCGCCUGACACGGGCGACAGCUGCGGCCCGCUGUGUUCACUCGGGCCGAGUGCGUCUCCUGUCAGGCA
AGGGAGAGCAGAGCCCCCCUG >hsa-mir-603 MI0003616 (SEQ ID NO: 1281)
GAUUGAUGCUGUUGGUUGGUGCAAAAGUAAUUGCAGUGCUUCCCAUUUAAAAGUAAUGGCACACACUGCAAUUACU
UUUGCUCCAACUUAAUACUU >hsa-mir-604 MI0003617 (SEQ ID NO: 1282)
AGAGCAUCGUGCUUGACCUUCCACGCUCUCGUGUCCACUAGCAGGCAGGUUUUCUGACACAGGCUGCGGAAUUCAGG
ACAGUGCAUCAUGGAGA >hsa-mir-605 MI0003618 (SEQ ID NO: 1283)
GCCCUAGCUUGGUUCUAAAUCCCAUGGUGCCUUCUCCUUGGGAAAAACAGAGAAGGCACUAUGAGAUUUAGAAUCAA
GUUAGG >hsa-mir-606 MI0003619 (SEQ ID NO: 1284)
UGUAUCCUUGGUUUUUAGUAGUUUUACUAUGAUGAGGUGUGCCAUCCACCCCAUCAUAGUAAACUACUGAAAAUCAA
AGAUACAAGUGCCUGACCA >hsa-mir-607 MI0003620 (SEQ ID NO: 1285)
UUGCCUAAAGUCACACAGGUUAUAGAUCUGGAUUGGAACCCAGGGAGCCAGACUGCCUGGGUUCAAAUCCAGAUCUA
UAACUUGUGUGACUUUGGG >hsa-mir-608 MI0003621 (SEQ ID NO: 1286)
GGGCCAAGGUGGGCCAGGGGUGGUGUUGGGACAGCUCCGUUUAAAAAGGCAUCUCCAAGAGCUUCCAUCAAAGGCUG
CCUCUUGGUGCAGCACAGGUAGA >hsa-mir-609 MI0003622 (SEQ ID NO: 1287)
UGCUCGGCUGUUCCUAGGGUGUUUCUCUCAUCUCUGGUCUAUAAUGGGUUAAAUAGUAGAGAUGAGGGCAACACCCU
AGGAACAGCAGAGGAACC >hsa-mir-610 MI0003623 (SEQ ID NO: 1288)
UCUAUUUGUCUUAGGUGAGCUAAAUGUGUGCUGGGACACAUUUGAGCCAAAUGUCCCAGCACACAUUUAGCUCACAU
AAGAAAAAUGGACUCUAGU >hsa-mir-611 MI0003624 (SEQ ID NO: 1289)
AAAAUGGUGAGAGCGUUGAGGGGAGUUCCAGACGGAGAUGCGAGGACCCCUCGGGGUCUGACCCACA >hsa-mir-612 MI0003625 (SEQ ID NO: 1290)
UCCCAUCUGGACCCUGCUGGGCAGGGCUUCUGAGCUCCUUAGCACUAGCAGGAGGGGCUCCAGGGGCCCUCCCUCCA
UGGCAGCCAGGACAGGACUCUCA >hsa-mir-613 MI0003626 (SEQ ID NO: 1291)
GGUGAGUGCGUUUCCAAGUGUGAAGGGACCCUUCCUGUAGUGUCUUAUAUACAAUACAGUAGGAAUGUUCCUUCUUU
GCCACUCAUACACCUUUA >hsa-mir-614 MI0003627 (SEQ ID NO: 1292)
UCUAAGAAACGCAGUGGUCUCUGAAGCCUGCAGGGGCAGGCCAGCCCUGCACUGAACGCCUGUUCUUGCCAGGUGGC
AGAAGGUUGCUGC >hsa-mir-615 MI0003628 (SEQ ID NO: 1293)
CUCGGGAGGGCGGGAGGGGGGUCCCCGGUGCUCGGAUCUCGAGGGUGCUUAUUGUUCGGUCCGAGCCUGGGUCUCC
CUCUUCCCCCCAACCCCCC >hsa-mir-616 MI0003629 (SEQ ID NO: 1294)
UUAGGUAAUUCCUCCACUCAAAACCCUUCAGUGACUUCCAUGACAUGAAAUAGGAAGUCAUUGGAGGGUUUGAGCAG
AGGAAUGACCUGUUUUAAAA >hsa-mir-617 MI0003631 (SEQ ID NO: 1295)
CAUCAUAAGGAGCCUAGACUUCCCAUUUGAAGGUGGCCAUUUCCUACCACCUUCAAAUGGUAAGUCCAGGCUCCUUC
UGAUUCAAUAAAUGAGGAGC >hsa-mir-618 MI0003632 (SEQ ID NO: 1296)
CUCUUGUUCACAGCCAAACUCUACUUGUCCUUCUGAGUGUAAUUACGUACAUGCAGUAGCUCAGGAGACAAGCAGGU
UUACCCUGUGGAUGAGUCUGA >hsa-mir-619 MI0003633 (SEQ ID NO: 1297)
CGCCCACCUCAGCCUCCCAAAAUGCUGGGAUUACAGGCAUGAGCCACUGCGGUCGACCAUGACCUGGACAUGUUUGU
GCCCAGUACUGUCAGUUUGCAG >hsa-mir-620 MI0003634 (SEQ ID NO: 1298)
AUAUAUAUCUAUAUCUAGCUCCGUAUAUAUAUAUAUAUAUAUAUAGAUAUCUCCAUAUAUAUGGAGAUAGAUAUAGA
AAUAAAACAAGCAAAGAA >hsa-mir-621 MI0003635 (SEQ ID NO: 1299)
UAGAUUGAGGAAGGGGCUGAGUGGUAGGCGGUGCUGCUGUGCUCUGAUGAAGACCCAUGUGGCUAGCAACAGCGCUU
ACCUUUUGUCUCUGGGUCC >hsa-mir-622 MI0003636 (SEQ ID NO: 1300)
AGAGAAGCUGGACAAGUACUGGUCUCAGCAGAUUGAGGAGAGCACCACAGUGGUCAUCACACAGUCUGCUGAGGUUG
GAGCUGCUGAGAUGACACU >hsa-mir-623 MI0003637 (SEQ ID NO: 1301)
GUACACAGUAGAAGCAUCCCUUGCAGGGGCUGUUGGGUUGCAUCCUAAGCUGUGCUGGAGCUUCCCGAUGUACUCUG
UAGAUGUCUUUGCACCUUCUG >hsa-mir-624 MI0003638 (SEQ ID NO: 1302)
AAUGCUGUUUCAAGGUAGUACCAGUACCUUGUGUUCAGUGGAACCAAGGUAAACACAAGGUAUUGGUAUUACCUUGA
GAUAGCAUUACACCUAAGUG >hsa-mir-625 MI0003639 (SEQ ID NO: 1303)
AGGGUAGAGGGAUGAGGGGGAAAGUUCUAUAGUCCUGUAAUUAGAUCUCAGGACUAUAGAACUUUCCCCCUCAUCCC
UCUGCCCU >hsa-mir-626 MI0003640 (SEQ ID NO: 1304)
ACUGAUAUAUUUGUCUUAUUUGAGAGCUGAGGAGUAUUUUUAUGCAAUCUGAAUGAUCUCAGCUGUCUGAAAAUGUC
UUCAAUUUUAAAGGCUU >hsa-mir-627 MI0003641 (SEQ ID NO: 1305)
UACUUAUUACUGGUAGUGAGUCUCUAAGAAAAGAGGAGGUGGUUGUUUUCCUCCUCUUUUCUUUGAGACUCACUACC
AAUAAUAAGAAAUACUACUA >hsa-mir-628 MI0003642 (SEQ ID NO: 1306)
AUAGCUGUUGUGUCACUUCCUCAUGCUGACAUAUUUACUAGAGGGUAAAAUUAAUAACCUUCUAGUAAGAGUGGCAG
UCGAAGGGAAGGGCUCAU >hsa-mir-629 MI0003643 (SEQ ID NO: 1307)
UCCCUUUCCCAGGGGAGGGGCUGGGUUUACGUUGGGAGAACUUUUACGGUGAACCAGGAGGUUCUCCCAACGUAAGC
CCAGCCCCUCCCCUCUGCCU >hsa-mir-630 MI0003644 (SEQ ID NO: 1308)
AACUUAACAUCAUGCUACCUCUUUGUAUCAUAUUUUGUUAUUCUGGUCACAGAAUGACCUAGUAUUCUGUACCAGGG
AAGGUAGUUCUUAACUAUAU >hsa-mir-631 MI0003645 (SEQ ID NO: 1309)
GUGGGGAGCCUGGUUAGACCUGGCCCAGACCUCAGCUACACAAGCUGAUGGACUGAGUCAGGGGCCACACUCUCC >hsa-mir-632 MI0003647 (SEQ ID NO: 1310)
CGCCUCCUACCGCAGUGCUUGACGGGAGGCGGAGCGGGGAACGAGGCCGUCGGCCAUUUUGUGUCUGCUUCCUGUGG
GACGUGGUGGUAGCCGU >hsa-mir-633 MI0003648 (SEQ ID NO: 1311)
AACCUCUCUUAGCCUCUGUUUCUUUAUUGCGGUAGAUACUAUUAACCUAAAAUGAGAAGGCUAAUAGUAUCUACCAC
AAUAAAAUUGUUGUGAGGAUA >hsa-mir-634 MI0003649 (SEQ ID NO: 1312)
AAACCCACACCACUGCAUUUUGGCCAUCGAGGGUUGGGGCUUGGUGUCAUGCCCCAAGAUAACCAGCACCCCAACUU
UGGACAGCAUGGAUUAGUCU >hsa-mir-635 MI0003650 (SEQ ID NO: 1313)
CAGAGAGGAGCUGCCACUUGGGCACUGAAACAAUGUCCAUUAGGCUUUGUUAUGGAAACUUCUCCUGAUCAUUGUUU
UGUGUCCAUUGAGCUUCCAAU >hsa-mir-636 MI0003651 (SEQ ID NO: 1314)
UGGCGGCCUGGGCGGGAGCGCGCGGGCGGGGCCGGCCCCGCUGCCUGGAAUUAACCCCGCUGUGCUUGCUCGUCCCG
CCCGCAGCCCUAGGCGGCGUCG >hsa-mir-637 MI0003652 (SEQ ID NO: 1315)
UGGCUAAGGUGUUGGCUCGGGCUCCCCACUGCAGUUACCCUCCCCUCGGCGUUACUGAGCACUGGGGGCUUUCGGGC
UCUGCGUCUGCACAGAUACUUC >hsa-mir-638 MI0003653 (SEQ ID NO: 1316)
GUGAGCGGGCGCGGCAGGGAUCGCGGGCGGGUGGCGGCCUAGGGCGCGGAGGGCGGACCGGGAAUGGCGCGCCGUGC
GCCGCCGGCGUAACUGCGGCGCU >hsa-mir-639 MI0003654 (SEQ ID NO: 1317)
UGGCCGACGGGCGCGCGCGGCCUGGAGGGGCGGGGCGGACGCAGAGCCGCGUUUAGUCUAUCGCUGCGGUUGCGAG
CGCUGUAGGGAGCCUGUGCUG >hsa-mir-640 MI0003655 (SEQ ID NO: 1318)
GUGACCCUGGGCAAGUUCCUGAAGAUCAGACACAUCAGAUCCCUUAUCUGUAAAAUGGGCAUGAUCCAGGAACCUGC
CUCUACGGUUGCCUUGGGG >hsa-mir-641 MI0003656 (SEQ ID NO: 1319)
UGGGUGAAAGGAAGGAAAGACAUAGGAUAGAGUCACCUCUGUCCUCUGUCCUCUACCUAUAGAGGUGACUGUCCUAU
GUCUUUCCUUCCUCUUACCCCU >hsa-mir-642a MI0003657 (SEQ ID NO: 1320)
AUCUGAGUUGGGAGGGUCCCUCUCCAAAUGUGUCUUGGGGUGGGGGAUCAAGACACAUUUGGAGAGGGAACCUCCCA
ACUCGGCCUCUGCCAUCAUU >hsa-mir-642b MI0016685 (SEQ ID NO: 1321)
GAGUUGGGAGGUUCCCUCUCCAAAUGUGUCUUGAUCCCCCACCCCAAGACACAUUUGGAGAGGGACCCUCCCAACUC >hsa-mir-643 MI0003658 (SEQ ID NO: 1322)
ACCAAGUGAUAUUCAUUGUCUACCUGAGCUAGAAUACAAGUAGUUGGCGUCUUCAGAGACACUUGUAUGCUAGCUCA
GGUAGAUAUUGAAUGAAAAA >hsa-mir-644a MI0003659 (SEQ ID NO: 1323)
UUUUUUUUUAGUAUUUUUCCAUCAGUGUUCAUAAGGAAUGUUGCUCUGUAGUUUUCUUAUAGUGUGGCUUUCUUAGA
GCAAAGAUGGUUCCCUA >hsa-mir-644b MI0019134 (SEQ ID NO: 1324)
UGGGCUAAGGGAGAUGAUUGGGUAGAAAGUAUUAUUCUAUUCAUUUGCCUCCCAGCCUACA >hsa-mir-645 MI0003660 (SEQ ID NO: 1325)
CAGUUCCUAACAGGCCUCAGACCAGUACCGGUCUGUGGCCUGGGGGUUGAGGACCCCUGCUCUAGGCUGGUACUGCU
GAUGCUUAAAAAGAGAG >hsa-mir-646 MI0003661 (SEQ ID NO: 1326)
GAUCAGGAGUCUGCCAGUGGAGUCAGCACACCUGCUUUUCACCUGUGAUCCCAGGAGAGGAAGCAGCUGCCUCUGAG
GCCUCAGGCUCAGUGGC >hsa-mir-647 MI0003662 (SEQ ID NO: 1327)
AGGAAGUGUUGGCCUGUGGCUGCACUCACUUCCUUCAGCCCCAGGAAGCCUUGGUCGGGGGCAGGAGGGAGGGUCAG
GCAGGGCUGGGGGCCUGAC >hsa-mir-648 MI0003663 (SEQ ID NO: 1328)
AUCACAGACACCUCCAAGUGUGCAGGGCACUGGUGGGGCCGGGGCAGGCCCAGCGAAAGUGCAGGACCUGGCACUU
AGUCGGAAGUGAGGGUG >hsa-mir-649 MI0003664 (SEQ ID NO: 1329)
GGCCUAGCCAAAUACUGUAUUUUUGAUCGACAUUUGGUUGAAAAAUAUCUAUGUAUUAGUAAACCUGUGUUGUUCAA
GAGUCCACUGUGUUUUGCUG >hsa-mir-650 MI0003665 (SEQ ID NO: 1330)
CAGUGCUGGGGUCUCAGGAGGCAGCGCUCUCAGGACGUCACCACCAUGGCCUGGGCUCUGCUCCUCCUCACCCUCCU
CACUCAGGGCACAGGUGAU >hsa-mir-651 MI0003666 (SEQ ID NO: 1331)
AAUCUAUCACUGCUUUUUAGGAUAAGCUUGACUUUUGUUCAAAUAAAAAUGCAAAAGGAAAGUGUAUCCUAAAAGGC
AAUGACAGUUUAAUGUGUUU >hsa-mir-652 MI0003667 (SEQ ID NO: 1332)
ACGAAUGGCUAUGCACUGCACAACCCUAGGAGAGGGUGCCAUUCACAUAGACUAUAAUUGAAUGGCGCCACUAGGGU
UGUGCAGUGCACAACCUACAC >hsa-mir-653 MI0003674 (SEQ ID NO: 1333)
UUCAUUCCUUCAGUGUUGAAACAAUCUCUACUGAACCAGCUUCAAACAAGUUCACUGGAGUUUGUUUCAAUAUUGCA
AGAAUGAUAAGAUGGAAGC >hsa-mir-654 MI0003676 (SEQ ID NO: 1334)
GGGUAAGUGGAAAGAUGGUGGGCCGCAGAACAUGUGCUGAGUUCGUGCCAUAUGUCUGCUGACCAUCACCUUUAGAA
GCCC >hsa-mir-655 MI0003677 (SEQ ID NO: 1335)
AACUAUGCAAGGAUAUUUGAGGAGAGGUUAUCCGUGUUAUGUUCGCUUCAUUCAUGAAUAAUACAUGGUUAACC
UCUUUUUGAAUAUCAGACUC >hsa-mir-656 MI0003678 (SEQ ID NO: 1336)
CUGAAAUAGGUUGCCUGUGAGGUGUUCACUUUCUAUAUGAUGAAUAUUAUACAGUCAACCUCUUUCCGAUAUCGAAUC >hsa-mir-657 MI0003681 (SEQ ID NO: 1337)
GUGUAGUAGAGCUAGGAGGAGAGGGUCCUGGAGAAGCGUGGACCGGUCCGGGUGGGUUCCGGCAGGUUCUCACCCUC
UCUAGGCCCCAUUCUCCUCUG >hsa-mir-658 MI0003682 (SEQ ID NO: 1338)
GCUCGGUUGCCGUGGUUGCGGGCCCUGCCCGCCCGCCAGCUCGCUGACAGCACGACUCAGGGCGGAGGGAAGUAGGU
CCGUUGGUCGGUCGGGAACGAGG >hsa-mir-659 MI0003683 (SEQ ID NO: 1339)
UACCGACCCUCGAUUUGGUUCAGGACCUUCCCUGAACCAAGGAAGAGUCACAGUCUCUUCCUUGGUUCAGGGAGGGU
CCCCAACAAUGUCCUCAUGG >hsa-mir-660 MI0003684 (SEQ ID NO: 1340)
CUGCUCCUUCUCCCAUACCCAUUGCAUAUCGGAGUUGUGAAUUCUCAAAACACCUCCUGUGUGCAUGGAUUACAGGA
GGGUGAGCCUUGUCAUCGUG >hsa-mir-661 MI0003669 (SEQ ID NO: 1341)
GGAGAGGCUGUGCUGUGGGGCAGGCGCAGGCCUGAGCCCUGGUUUCGGGCUGCCUGGGUCUCUGGCCUGCGCGUGAC
UUUGGGGUGGCU >hsa-mir-662 MI0003670 (SEQ ID NO: 1342)
GCUGUUGAGGCUGCGCAGCCAGGCCCUGACGGUGGGGUGGCUGCGGGCCUUCUGAAGGUCUCCCACGUUGUGGCCCA
GCAGCGCAGUCACGUUGC >hsa-mir-663a MI0003672 (SEQ ID NO: 1343)
CCUUCCGGCGUCCCAGGCGGGGCGCCGCGGGACCGCCCUCGUGUCUGUGGCGGUGGGAUCCCGCGGCCGUGUUUUCC
UGGUGGCCCGGCCAUG >hsa-mir-663b MI0006336 (SEQ ID NO: 1344)
GGUGCCGAGGGCCGUCCGGCAUCCUAGGCGGGUCGCUGCGGUACCUCCCUCCUGUCUGUGGCGGUGGGAUCCCGUGG
CCGUGUUUCCUGGUGGCCCGGCCGUGCCUGAGGUUUC >hsa-mir-664 MI0006442 (SEQ ID NO: 1345)
GAACAUUGAAACUGGCUAGGGAAAAUGAUUGGAUAGAAACUAUUAUUCUAUUCAUUUAUCCCCAGCCUACAAAAUGA
AAAAA >hsa-mir-665 MI0005563 (SEQ ID NO: 1346)
UCUCCUCGAGGGGUCUCUGCCUCUACCCAGGACUCUUUCAUGACCAGGAGGCUGAGGCCCCUCACAGGCGGC >hsa-mir-668 MI0003761 (SEQ ID NO: 1347)
GGUAAGUGCGCCUCGGGUGAGCAUGCACUUAAUGUGGGUGUAUGUCACUCGGCUCGGCCCACUACC >hsa-mir-670 MI0003933 (SEQ ID NO: 1348)
GUUUAGGGGUGGACCUGAUGUCCCUGAGUGUAUGUGGUGAACCUGAAUUUGCCUUGGGUUUCCUCAUAUUCAUUCAG
GAGUGUCAGUUGCCCCUUCAC >hsa-mir-671 MI0003760 (SEQ ID NO: 1349)
GCAGGUGAACUGGCAGGCCAGGAAGAGGAGGAAGCCCUGGAGGGGCUGGAGGUGAUGGAUGUUUUCCUCCGGUUCUC
AGGGCUCCACCUCUUUCGGGCCGUAGAGCCAGGGCUGGUGC >hsa-mir-675 MI0005416 (SEQ ID NO: 1350)
CCCAGGGUCUGGUGCGGAGAGGGCCCACAGUGGACUUGGUGACGCUGUAUGCCCUCACCGCUCAGCCCCUGGG >hsa-mir-676 MI0016436 (SEQ ID NO: 1351)
GCAUGACUCUUCAACCUCAGGACUUGCAGAAUUAAUGGAAUGCUGUCCUAAGGUUGUUGAGUUGUGC >hsa-mir-708 MI0005543 (SEQ ID NO: 1352)
AACUGCCCUCAAGGAGCUUACAAUCUAGCUGGGGGUAAAUGACUUGCACAUGAACACAACUAGACUGUGAGCUUCUA
GAGGGCAGGGA >hsa-mir-711 MI0012488 (SEQ ID NO: 1353)
ACUGACUUUGAGUCUCUCCUCAGGGUGCUGCAGGCAAAGCUGGGGACCCAGGGAGAGACGUAAGUGAGGGGAGAUG >hsa-mir-718 MI0012489 (SEQ ID NO: 1354)
GGCCGCGGCGCGCAAGAUGGCGGCGGGCCCGGGCACCGCCCCUUCCGCCCCGCCGGGCGUCGCACGAGGC >hsa-mir-720 MI0006654 (SEQ ID NO: 1355)
CCGGAUCUCACACGGUGGUGUUUAAUAUCUCGCUGGGGCCUCCAAAAUGUUGUGCCCAGGGGUGUUAGAGAAAACACC
ACACUUUGAGAUGAAUUAAGAGUCCUUUAUUAG >hsa-mir-744 MI0005559 (SEQ ID NO: 1356)
UUGGGCAAGGUGCGGGGCUAGGGCUAACAGCAGUCUUACUGAAGGUUUCCUGGAAACCACGCACAUGCUGUUGCCAC
UAACCUCAACCUUACUCGGUC >hsa-mir-758 MI0003757 (SEQ ID NO: 1357)
GCCUGGAUACAUGAGAUGGUUGACCAGAGAGCACACGCUUUAUUUGUGCCGUUUGUGACCUGGUCCACUAACCCUCA
GUAUCUAAUGC >hsa-mir-759 MI0004065 (SEQ ID NO: 1358)
UAAUAAAUUAAAUGCCUAAACUGGCAGAGUGCAAACAAUUUUGACUCAGAUCUAAAUGUUUGCACUGGCUGUUUAAA
CAUUUAAUUUGUUA >hsa-mir-760 MI0005567 (SEQ ID NO: 1359)
GGCGCGUCGCCCCCCUCAGUCCACCAGAGCCCGGAUACCUCAGAAAUUCGGCUCUGGGUCUGUGGGGAGCGAAAUGC
AAC >hsa-mir-761 MI0003941 (SEQ ID NO: 1360)
GGAGGAGCAGCAGGGUGAAACUGACACAGUUCUGGUGAGUUUCACUUUGCUGCUCCUCC >hsa-mir-762 MI0003892 (SEQ ID NO: 1361)
GGCCCGGCUCCGGGUCUCGGCCCGUACAGUCCGGCCGGCCAUGCUGGCGGGGCUGGGGCCGGGGCCGAGCCCGCGGC
GGGGCC >hsa-mir-764 MI0003944 (SEQ ID NO: 1362)
AAUCUAGGAGGCAGGUGCUCACUUGUCCUCCUCCAUGCUUGGAAAAUGCAGGGAGGAGGCCAUAGUGGCAACUGUUA
CCAUGAUU >hsa-mir-765 MI0005116 (SEQ ID NO: 1363)
UUUAGGCGCUGAUGAAAGUGGAGUUCAGUAGACAGCCCUUUUCAAGCCCUACGAGAAACUGGGGUUUCUGGAGGAGA
AGGAAGGUGAUGAAGGAUCUGUUCUCGUGAGCCUGAA >hsa-mir-766 MI0003836 (SEQ ID NO: 1364)
GCAUCCUCAGGACCUGGGCUUGGGUGGUAGGAGGAAUUGGUGCUGGUCUUUCAUUUUGGAUUUGACUCCAGCCCCAC
AGCCUCAGCCACCCCAGCCAAUUGUCAUAGGAGC >hsa-mir-767 MI0003763 (SEQ ID NO: 1365)
GCUUUUAUAUUGUAGGUUUUUGCUCAUGCACCAUGGUUGUCUGAGCAUGCAGCAUGCUUGUCUGCUCAUACCCCAUG
GUUUCUGAGCAGGAACCUUCAUUGUCUACUGC >hsa-mir-769 MI0003834 (SEQ ID NO: 1366)
GCCUUGGUGCUGAUUCCUGGGCUCUGACCUGAGACCUCUGGGUUCUGAGCUGUGAUGUUGCUCUCGAGCUGGGAUCU
CCGGGGUCUUGGUUCAGGGCCGGGGCCUCUGGGUUCCAAGC >hsa-mir-770 MI0005118 (SEQ ID NO: 1367)
AGGAGCCACCUUCCGAGCCUCCAGUACCACGUGUCAGGGCCACAUGAGCUGGGCCUCGUGGGCCUGAUGUGGUGCUG
GGGCCUCAGGGGUCUGCUCUU >hsa-mir-802 MI0003906 (SEQ ID NO: 1368)
GUUCUGUUAUUUGCAGUCAGUAACAAAGAUUCAUCCUUGUGUCCAUCAUGCAACAAGGAGAAUCUUUGUCACUUAGU
GUAAUUAAUAGCUGGAC >hsa-mir-873 MI0005564 (SEQ ID NO: 1369)
GUGUGCAUUUGCAGGAACUUGUGAGUCUCCUAUUGAAAAUGAACAGGAGACUGAUGAGUUCCCGGGAACACCCACAA >hsa-mir-874 MI0005532 (SEQ ID NO: 1370)
UUAGCCCUGCGGCCCCACGCACCAGGGUAAGAGAGACUCUCGCUUCCUGCCCUGGCCCGAGGGACCGACUGGCUGGGC >hsa-mir-875 MI0005541 (SEQ ID NO: 1371)
UUAGUGGUACUAUACCUCAGUUUUAUCAGGUGUUCUUAAAAUCACCUGGAAACACUGAGGUUGUGUCUCACUGAAC >hsa-mir-876 MI0005542 (SEQ ID NO: 1372)
UGAAGUGCUGUGGAUUUCUUUGUGAAUCACCAUAUCUAAGCUAAUGUGGUGGUGGUUUACAAAGUAAUUCAUAGUGC
UUCA >hsa-mir-877 MI0005561 (SEQ ID NO: 1373)
GUAGAGGAGAUGGCGCAGGGGACACGGGCAAAGACUUGGGGGUUCCUGGGACCCUCAGACGUGUGUCCUCUUCUCCC
UCCUCCCAG >hsa-mir-885 MI0005560 (SEQ ID NO: 1374)
CCGCACUCUCUCCAUUACACUACCCUGCCUCUUCUCCAUGAGAGGCAGCGGGGUGUAGUGGAUAGAGCACGGGU >hsa-mir-887 MI0005562 (SEQ ID NO: 1375)
GUGCAGAUCCUUGGGAGCCCUGUUAGACUCUGGAUUUUACACUUGGAGUGAACGGGCGCCAUCCCGAGGCUUUGCAC
AG >hsa-mir-888 MI0005537 (SEQ ID NO: 1376)
GGCAGUGCUCUACUCAAAAAGCUGUCAGUCACUUAGAUUACAUGUGACUGACACCUCUUUGGGUGAAGGAAGGCUCA >hsa-mir-889 MI0005540 (SEQ ID NO: 1377)
GUGCUUAAAGAAUGGCUGUCCGUAGUAUGGUCUCUAUAUUUAUGAUGAUUAAUAUCGGACAACCAUUGUUUUAGUAU
CC >hsa-mir-890 MI0005533 (SEQ ID NO: 1378)
GGAAGUGCCCUACUUGGAAAGGCAUCAGUUGCUUAGAUUACAUGUAACUAUUCCCUUUCUGAGUAGAGUAAGUCUUA >hsa-mir-891a MI0005524 (SEQ ID NO: 1379)
CCUUAAUCCUUGCAACGAACCUGAGCCACUGAUUCAGUAAAAUACUCAGUGGCACAUGUUUGUUGUGAGGGUCAAAA
GA >hsa-mir-891b MI0005534 (SEQ ID NO: 1380)
CCUUAAUCCUUGCAACUUACCUGAGUCAUUGAUUCAGUAAAACAUUCAAUGGCACAUGUUUGUUGUUAGGGUCAAAA
GA >hsa-mir-892a MI0005528 (SEQ ID NO: 1381)
GCAGUGCCUUACUCAGAAAGGUGCCAGUCACUUACACUACAUGUCACUGUGUCCUUUCUGCGUAGAGUAAGGCUC >hsa-mir-892b MI0005538 (SEQ ID NO: 1382)
UGCAAUGCCCUACUCAGAAAGGUGCCAUUUAUGUAGAUUUUAUGUCACUGGCUCCUUUCUGGGUAGAGCAAGGCUCA >hsa-mir-920 MI0005712 (SEQ ID NO: 1383)
GUAGUUGUUCUACAGAAGACCUGGAUGUGUAGGAGCUAAGACACACUCCAGGGGAGCUGUGGAAGCAGUAACACG >hsa-mir-921 MI0005713 (SEQ ID NO: 1384)
ACUAGUGAGGGACAGAACCAGGAUUCAGACUCAGGUCCAUGGGCCUGGAUCACUGG -continued >hsa-mir-922 MI0005714 (SEQ ID NO: 1385)
AUGGCGUUUUCCCUCUCCCUGUCCUGGACUGGGGUCAGACUGUGCCCCGAGGAGAAGCAGCAGAGAAUAGGACUACG
UCAU >hsa-mir-924 MI0005716 (SEQ ID NO: 1386)
AAUAGAGUCUUGUGAUGUCUUGCUUAAGGGCCAUCCAACCUAGAGUCUACAAC >hsa-mir-933 MI0005755 (SEQ ID NO: 1387)
ACUUGGGUCAGUUCAGAGGUCCUCGGGGCGCGCGUCGAGUCAGCCGUGUGCGCAGGGAGACCUCUCCCACCCACAGU >hsa-mir-934 MI0005756 (SEQ ID NO: 1388)
AGAAAUAAGGCUUCUGUCUACUACUGGAGACACUGGUAGUAUAAAACCCAGAGUCUCCAGUAAUGGACGGGAGCCUU
AUUUCU >hsa-mir-935 MI0005757 (SEQ ID NO: 1389)
GGCGGGGGCGCGGGCGGCAGUGGCGGGAGCGGCCCCUCGGCCAUCCUCCGUCUGCCCAGUUACCGCUUCCGCUACCG
CCGCCGCUCCCGCU >hsa-mir-936 MI0005758 (SEQ ID NO: 1390)
UCAAGGCCACUGGGACAGUAGAGGGAGGAAUCGCAGAAAUCACUCCAGGAGCAACUGAGAGACCUUGCUUCUACUUU
ACCAGGUCCUGCUGGCCCAGA >hsa-mir-937 MI0005759 (SEQ ID NO: 1391)
AGCACUGCCCCGGUGAGUCAGGGUGGGGCUGGCCCCCUGCUUCGUGCCCAUCCGCGCUCUGACUCUCUGCCCACCU
GCAGGAGCU >hsa-mir-938 MI0005760 (SEQ ID NO: 1392)
GAAGGUGUACCAUGUGCCCUUAAAGGUGAACCCAGUGCACCUUCAUGAACCGUGGUACACCUUUAAGAACUUGGUAU
GCCUUC >hsa-mir-939 MI0005761 (SEQ ID NO: 1393)
UGUGGGCAGGGCCCUGGGGAGCUGAGGCUCUGGGGGUGGCCGGGGCUGACCCUGGGCCUCUGCUCCCCAGUGUCUGA
CCGCG >hsa-mir-940 MI0005762 (SEQ ID NO: 1394)
GUGAGGUGUGGGCCCGGCCCCAGGAGCGGGGCCUGGGCAGCCCCGUGUGUUGAGGAAGGAAGGCAGGGCCCCCGCUC
CCCGGGCCUGACCCCAC >hsa-mir-941-1 MI0005763 (SEQ ID NO: 1395)
CACGGAAGAGGACACACCCGGCUGUGUGGACAUGUGCCCAGGGCCCGGGACAGCGCCACGGAAGAGGACGCACCCGG
CUGUGUGCACAUGUGCCCAGGGCCCGGGACAGCGCCACGG >hsa-mir-941-2 MI0005764 (SEQ ID NO: 1396)
CACGGAAGAGGACGCACCCGGCUGUGUGCACAUGUGCCCAGGGCCCGGGACAGCGCCACGGAAGAGGACGCACCCGG
CUGUGUGCACAUGUGCCCAGGGCCCGGGACAGCGCCACGG >hsa-mir-941-3 MI0005765 (SEQ ID NO: 1397)
CACGGAAGAGGACGCACCCGGCUGUGUGCACAUGUGCCCAGGGCCCGGGACAGCGCCACGGAAGAGGACGCACCCGG
CUGUGUGCACAUGUGCCCAGGGCCCGGGACAGCGCCAUGG >hsa-mir-941-4 MI0005766 (SEQ ID NO: 1398)
CAUGGAAGAGGACGCACCCGGCUGUGUGCACAUGUGCCCAGGGCCCGGGACAGCGCCACGGAAGAGGACGCACCCGG
CUGUGUGCACAUGUGCCCAGGGCCCGGGACAGCGCCACGG >hsa-mir-942 MI0005767 (SEQ ID NO: 1399)
AUUAGGAGAGUAUCUUCUCUGUUUUGGCCAUGUGUGUACUCACAGCCCCUCACACAUGGCCGAAACAGAGAAGUUAC
UUUCCUAAU >hsa-mir-943 MI0005768 (SEQ ID NO: 1400)
GGGACGUUCUGAGCUCGGGUGGGGGACGUUUGCCGGUCACUGCUGCUGGCGCCCGACUGUUGCCGUCCUCCAGCC
CCACUCAAAGGCAUCCC >hsa-mir-944 MI0005769 (SEQ ID NO: 1401)
GUUCCAGACACAUCUCAUCUGAUAUACAAUAUUUUCUUAAAUUGUAUAAAGAGAAAUUAUUGUACAUCGGAUGAGCU
GUGUCUGGGAU >hsa-mir-1178 MI0006271 (SEQ ID NO: 1402)
GCGUUGGCUGGCAGAGGAAGGGAAGGGUCCAGGGUCAGCUGAGCAUGCCCUCAGGUUGCUCACUGUUCUUCCCUAGA
AUGUCAGGUGAUGU >hsa-mir-1179 MI0006272 (SEQ ID NO: 1403)
GGCUGGAAAGGAAGAAGCAUUCUUUCAUUGGUUGGUGUGUAUUGCCUUGUCAACCAAUAAGAGGAUGCCAUUUAUCC
UUUUCUGACUAGCU >hsa-mir-1180 MI0006273 (SEQ ID NO: 1404)
GCUGCUGGACCCACCCGGCCGGGAAUAGUGCUCCUGGUUGUUUCCGGCUCGCGUGGGUGUGUCGGCGGC >hsa-mir-1181 MI0006274 (SEQ ID NO: 1405)
UCCACUGCUGCCGCCGUCGCCGCCACCCGAGCCGGAGCGGGCUGGGCCGCCAAGGCAAGAUGGUGGACUACAGCGUG
UGGG -continued >hsa-mir-1182 MI0006275 (SEQ ID NO: 1406)
GGGACUUGUCACUGCCUGUCUCCUCCCUCUCCAGCAGCGACUGGAUUCUGGAGUCCAUCUAGAGGGUCUUGGGAGGG
AUGUGACUGUUGGGAAGCCC >hsa-mir-1183 MI0006276 (SEQ ID NO: 1407)
AUUAUUCAAAUGCUCGGAGACACAGAACAUUAGAGAAGACAGGAGUUCACUGUAGGUGAUGGUGAGAGUGGGCAUGG
AGCAGGAGUGCC >hsa-mir-1184-1 MI0006277 (SEQ ID NO: 1408)
CUUGCAGAACGAGGUGAAGGAGGUGGUUCUGCUCAGCAGUCAACAGUGGCCACAUCUCCACCUGCAGCGACUUGAUG
GCUUCCGUGUCCUUUUCGUGGG >hsa-mir-1184-2 MI0015971 (SEQ ID NO: 1409)
CUUGCAGAACGAGGUGAAGGAGGUGGUUCUGCUCAGCAGUCAACAGUGGCCACAUCUCCACCUGCAGCGACUUGAUG
GCUUCCGUGUCCUUUUCGUGGG >hsa-mir-1184-3 MI0015972 (SEQ ID NO: 1410)
CUUGCAGAACGAGGUGAAGGAGGUGGUUCUGCUCAGCAGUCAACAGUGGCCACAUCUCCACCUGCAGCGACUUGAUG
GCUUCCGUGUCCUUUUCGUGGG >hsa-mir-1185-1 MI0003844 (SEQ ID NO: 1411)
UUUGGUACUUGAAGAGAGGAUACCCUUUGUAUGUUCACUUGAUUAAUGGCGAAUAUACAGGGGGAGACUCUUAUUUG
CGUAUCAAA >hsa-mir-1185-2 MI0003821 (SEQ ID NO: 1412)
UUUGGUACUUAAAGAGAGGAUACCCUUUGUAUGUUCACUUGAUUAAUGGCGAAUAUACAGGGGGAGACUCUCAUUUG
CGUAUCAAA >hsa-mir-1193 MI0014205 (SEQ ID NO: 1413)
GUAGCUGAGGGGAUGGUAGACCGGUGACGUGCACUUCAUUUACGAUGUAGGUCACCCGUUUGACUAUCCACCAGCGCC >hsa-mir-1197 MI0006656 (SEQ ID NO: 1414)
ACUUCCUGGUAUUUGAAGAUGCGGUUGACCAUGGUGUGUACGCUUUAUUUGUGACGUAGGACACAUGGUCUACUUCU
UCUCAAUAUCA >hsa-mir-1200 MI0006332 (SEQ ID NO: 1415)
UGCUACUUCUCCUGAGCCAUUCUGAGCCUCAAUCACUUGCCAGAGAGAUUGGUUCAGGAAUUUGUCAGGGAUAGCC >hsa-mir-1202 MI0006334 (SEQ ID NO: 1416)
CCUGCUGCAGAGGUGCCAGCUGCAGUGGGGGAGGCACUGCCAGGGCUGCCCACUCUGCUUAGCCAGCAGGUGCCAAG
AACAGG >hsa-mir-1203 MI0006335 (SEQ ID NO: 1417)
UCCUCCCCGGAGCCAGGAUGCAGCUCAAGCCACAGCAGGGUGUUUAGCGCUCUUCAGUGGCUCCAGAUUGUGGCGCU
GGUGCAGG >hsa-mir-1204 MI0006337 (SEQ ID NO: 1418)
ACCUCGUGGCCUGGUCUCCAUUAUUUGAGAUGAGUUACAUCUUGGAGGUGAGGACGUGCCUCGUGGU >hsa-mir-1205 MI0006338 (SEQ ID NO: 1419)
GAAGGCCUCUGCAGGGUUUGCUUUGAGGUACUUCCUUCCUGUCAACCCUGUUCUGGAGUCUGU >hsa-mir-1206 MI0006339 (SEQ ID NO: 1420)
CAGUGUUCAUGUAGAUGUUUAAGCUCUUGCAGUAGGUUUUUGCAAGCUAGUGAACGCUG >hsa-mir-1207 MI0006340 (SEQ ID NO: 1421)
GCAGGGCUGGCAGGGAGGCUGGGAGGGGCUGGCUGGGUCUGGUAGUGGGCAUCAGCUGGCCCUCAUUUCUUAAGACA
GCACUUCUGU >hsa-mir-1208 MI0006341 (SEQ ID NO: 1422)
CACCGGCAGAAUCACUGUUCAGACAGGCGGAGACGGGUCUUUCUCGCCCUCUGAUGAGUCACCACUGUGGUGG >hsa-mir-1224 MI0003764 (SEQ ID NO: 1423)
GUGAGGACUCGGGAGGUGGAGGGUGGUGCCGCCGGGGCCGGGCGCUGUUUCAGCUCGCUUCUCCCCCCACCUCCUCU
CUCCUCAG >hsa-mir-1225 MI0006311 (SEQ ID NO: 1424)
GUGGGUACGGCCCAGUGGGGGGAGAGGGACACGCCCUGGGCUCUGCCCAGGGUGCAGCCGGACUGACUGAGCCCCU
GUGCCGCCCCAG >hsa-mir-1226 MI0006313 (SEQ ID NO: 1425)
GUGAGGGCAUGCAGGCCUGGAUGGGGCAGCUGGGAUGGUCCAAAAGGGUGGCCUCACCAGCCCUGUGUUCCCUAG >hsa-mir-1227 MI0006316 (SEQ ID NO: 1426)
GUGGGGCCAGGCGGUGGUGGGCACUGCUGGGGUGGGCACAGCAGCCAUGCAGAGCGGGCAUUUGACCCCGUGCCACC
CUUUUCCCCAG >hsa-mir-1228 MI0006318 (SEQ ID NO: 1427)
GUGGGCGGGGCAGGUGUGUGGUGGGUGGUGGCCUGCGGUGAGCAGGGCCCUCACACCUGCCUCGCCCCCCAG -continued >hsa-mir-1229 MI0006319 (SEQ ID NO: 1428)
GUGGGUAGGGUUUGGGGGAGAGCGUGGGCUGGGGUUCAGGGACACCCUCUCACCACUGCCCUCCCACAG >hsa-mir-1231 MI0006321 (SEQ ID NO: 1429)
GUCAGUGUCUGGGCGGACAGCUGCAGGAAAGGGAAGACCAAGGCUUGCUGUCUGUCCAGUCUGCCACCCUACCCUGU
CUGUUCUUGCCACAG >hsa-mir-1233-1 MI0006323 (SEQ ID NO: 1430)
GUGAGUGGGAGGCCAGGGCACGGCAGGGGAGCUGCAGGGCUAUGGGAGGGGCCCCAGCGUCUGAGCCCUGUCCUCC
CGCAG >hsa-mir-1233-2 MI0015973 (SEQ ID NO: 1431)
GUGAGUGGGAGGCCAGGGCACGGCAGGGGAGCUGCAGGGCUAUGGGAGGGGCCCCAGCGUCUGAGCCCUGUCCUCC
CGCAG >hsa-mir-1234 MI0006324 (SEQ ID NO: 1432)
GUGAGUGUGGGGUGGCUGGGGGGGGGGGGGGGCCGGGGACGGCUUGGGCCUGCCUAGUCGGCCUGACCACCCAC
CCCACAG >hsa-mir-1236 MI0006326 (SEQ ID NO: 1433)
GUGAGUGACAGGGGAAAUGGGGAUGGACUGGAAGUGGGCAGCAUGGAGCUGACCUUCAUCAUGGCUUGGCCAACAUA
AUGCCUCUUCCCCUUGUCUCUCCAG >hsa-mir-1237 MI0006327 (SEQ ID NO: 1434)
GUGGGAGGGCCCAGGCGCGGGCAGGGGUGGGGGUGGCAGAGCGCUGUCCCGGGGGCGGGGCCGAAGCGCGGCGACCG
UAACUCCUUCUGCUCCGUCCCCCAG >hsa-mir-1238 MI0006328 (SEQ ID NO: 1435)
GUGAGUGGGAGCCCCAGUGUGUGGUUGGGGCCAUGGCGGGUGGGCAGCCCAGCCUCUGAGCCUUCCUCGUCUGUCUG
CCCCAG >hsa-mir-1243 MI0006373 (SEQ ID NO: 1436)
CUAAAACUGGAUCAAUUAUAGGAGUGAAAUAAAGGUCCAUCUCCUGCCUAUUUAUUACUUUGCUUUGGUAAUAAAUC
UAUUUUUAAAAGAACC >hsa-mir-1244-1 MI0006379 (SEQ ID NO: 1437)
AUCUUAUUCCGAGCAUUCCAGUAACUUUUUUGUGUAUGUACUUAGCUGUACUAUAAGUAGUUGGUUUGUAUGAGAUG
GUUAAAAA >hsa-mir-1244-2 MI0015974 (SEQ ID NO: 1438)
AUCUUAUUCCGAGCAUUCCAGUAACUUUUUUGUGUAUGUACUUAGCUGUACUAUAAGUAGUUGGUUUGUAUGAGAUG
GUUAAAAA >hsa-mir-1244-3 MI0015975 (SEQ ID NO: 1439)
AUCUUAUUCCGAGCAUUCCAGUAACUUUUUUGUGUAUGUACUUAGCUGUACUAUAAGUAGUUGGUUUGUAUGAGAUG
GUUAAAAA >hsa-mir-1245a MI0006380 (SEQ ID NO: 1440)
AUUUAUGUAUAGGCCUUUAGAUCAUCUGAUGUUGAAUACUCUUUAAGUGAUCUAAAGGCCUACAUAUAAA >hsa-mir-1245b MI0017431 (SEQ ID NO: 1441)
UUUAUAUGUAGGCCUUUAGAUCACUUAAAGAGUAUUCAACAUCAGAUGAUCUAAAGGCCUAUACAUAAA >hsa-mir-1246 MI0006381 (SEQ ID NO: 1442)
UGUAUCCUUGAAUGGAUUUUUGGAGCAGGAGUGGACACCUGACCCAAAGGAAAUCAAUCCAUAGGCUAGCAAU >hsa-mir-1247 MI0006382 (SEQ ID NO: 1443)
CCGCUUGCCUCGCCCAGCGCAGCCCCGGCCGCUGGGCGCACCCGUCCCGUUCGUCCCCGACGUUGCUCUCUACCCC
GGGAACGUCGAGACUGGAGCGCCCGAACUGAGCCACCUUCGCGGACCCCGAGAGCGGCG >hsa-mir-1248 MI0006383 (SEQ ID NO: 1444)
UUUACCUUCUUGUAUAAGCACUGUGCUAAAAUUGCAGACACUAGGACCAUGUCUUGGUUUUUGCAAUAAUGCUAGCA
GAGUACACACAAGAAGAAAAGUAACAGCA >hsa-mir-1249 MI0006384 (SEQ ID NO: 1445)
GGGAGGAGGGAGGAGAUGGGCCAAGUUCCCUCUGGCUGGAACGCCCUUCCCCCCCUUCUUCACCUG >hsa-mir-1250 MI0006385 (SEQ ID NO: 1446)
CUGUCCCGCUGGCCUGGCAGGUGACGGUGCUGGAUGUGGCCUUUUUGCCUUUUCUAAAGGCCACAUUUUCCAGCCCA
UUCAACCUUCCAGAGCCCUCUGAAGUGGCCACAGGC >hsa-mir-1251 MI0006386 (SEQ ID NO: 1447)
GUGGACUCUAGCUGCCAAAGGCGCUUCUCCUUCUGAACAGAGCGCUUUGCUCAGCCAGUGUAGACAUGGC >hsa-mir-1252 MI0006434 (SEQ ID NO: 1448)
AGAAAGAAGGAAAUUGAAUUCAUUUAGAAAAGAGAAUUCCAAAUGAGCUUAAUUUCCUUUUUUCU >hsa-mir-1253 MI0006387 (SEQ ID NO: 1449)
AGCAGCAAGAGAUAGAAUCCAAAAGAGAAGAAGAUCAGCCUGCAGAUGUGGACUGCUAAAUGCAGGCUGAUCUUCUC
CCCUUUGGGAUUCUCUUAUGAGAAGCCA >hsa-mir-1254-1 MI0006388 (SEQ ID NO: 1450)
GGUGGGAGGAUUGCUUGAGCCUGGAAGCUGGAGCCUGCAGUGAACUAUCAUUGUGCCACUGUACUCCAGCCUAGGCA
ACAAAAUGAAAUCCUGUCUA >hsa-mir-1254-2 MI0016747 (SEQ ID NO: 1451)
CUGAGCCUGGAAGCUGGAGCCUGCAGUGAGCUAUGAUCAUGUCCCUGUACUCUAGCCUGGGCA >hsa-mir-1255a MI0006389 (SEQ ID NO: 1452)
AUUGGAAAUCUUUGAGUUGCUUCUCAAGGAUGAGCAAAGAAAGUAGAUUUUUUAGAUUCUAAAGAAACUAUCUUCU
UUGCUCAUCCUUGAGAAGCAACUCCUUAUCCAUUAA >hsa-mir-1255b-1 MI0006435 (SEQ ID NO: 1453)
UACGGAUGAGCAAAGAAAGUGGUUUCUUAAAAUGGAAUCUACUCUUUGUGAAGAUGCUGUGAA >hsa-mir-1255b-2 MI0006436 (SEQ ID NO: 1454)
UCUUACGGAUGAGCAAAGAAAGUGGUUUGCGCCUCAAGAAACCACUUUCUUUGCUCAUCCAUAAGGA >hsa-mir-1256 MI0006390 (SEQ ID NO: 1455)
AGUCAGCCUGUUGAAGCUUUGAAGCUUUGAUGCCAGGCAUUGACUUCUCACUAGCUGUGAAAGUCCUAGCUAAAGAG
AAGUCAAUGCAUGACAUCUUGUUUCAAUAGAUGGCUGUUUCA >hsa-mir-1257 MI0006391 (SEQ ID NO: 1456)
GCCCUGGGCUUGUGCUGGGGGAGUGAAUGAUGGGUUCUGACCCCCAUGCACCCCUGUGGGCCCCUGGCAUCACUGGC
CCCAUCCUUCACCCCUGCCAACCACGCUUGCCCUGUGCCU >hsa-mir-1258 MI0006392 (SEQ ID NO: 1457)
CUGUGGCUUCCACGACCUAAUCCUAACUCCUGCGAGUCCCUGGAGUUAGGAUUAGGUCGUGGAAGCCACAGGA >hsa-mir-1260a MI0006394 (SEQ ID NO: 1458)
ACCUUUCCAGCUCAUCCCACCUCUGCCACCAAAACACUCAUCGCGGGGUCAGAGGGAGUGCCAAAAAAGGUAA >hsa-mir-1260b MI0014197 (SEQ ID NO: 1459)
UCUCCGUUUAUCCCACCACUGCCACCAUUAUUGCUACUGUUCAGCAGGUGCUGCUGGUGGUGAUGGUGAUAGUCUGG
UGGGGGCGGUGG >hsa-mir-1261 MI0006396 (SEQ ID NO: 1460)
UGCUAUGGAUAAGGCUUUGGCUUAUGGGGAUAUUGUGGUUGAUCUGUUCUAUCCAGAUGACUGAAACUUUCUCCAUA
GCAGC >hsa-mir-1262 MI0006397 (SEQ ID NO: 1461)
AUCUACAAUGGUGAUGGGUGAAUUUGUAGAAGGAUGAAAGUCAAAGAAUCCUUCUGGGAACUAAUUUUUGGCCUUCA
ACAAGAAUUGUGAUAU >hsa-mir-1263 MI0006398 (SEQ ID NO: 1462)
CUACCCCAAAAUAUGGUACCCUGGCAUACUGAGUAUUUUAAUACUGGCAUACUCAGUAUGCCAUGUUGCCAUAUUUU
GGGGUAGCA >hsa-mir-1264 MI0003758 (SEQ ID NO: 1463)
AGGUCCUCAAUAAGUAUUUGUUGAAAGAAUAAAUAAACCAACAAGUCUUAUUUGAGCACCUGUUAUGUG >hsa-mir-1265 MI0006401 (SEQ ID NO: 1464)
AUGGUUUGGGACUCAGGAUGUGGUCAAGUGUUGUUAAGGCAUGUUCAGGAACAAUACUUGACCACAUUUUGAAUUCC
AAACCAUAU >hsa-mir-1266 MI0006403 (SEQ ID NO: 1465)
ACAGGUAGUGUCCCUCAGGGCUGUAGAACAGGGCUGGGAUUACUAAAGCCCUGUUCUAUGCCCUGAGGGACACUGAG
CAUGUCA >hsa-mir-1267 MI0006404 (SEQ ID NO: 1466)
CUCCCAAAUCUCCUGUUGAAGUGUAAUCCCCACCUCCAGCAUUGGGGAUUACAUUUCAACAUGAGAUUUGGAUGAGGA >hsa-mir-1268a MI0006405 (SEQ ID NO: 1467)
UAGCCGGGCGUGGUGGUGGGGCCUGUGGUCCCAGCUACUUUGGAGGCUGAG >hsa-mir-1268b MI0016748 (SEQ ID NO: 1468)
ACCCGGGCGUGGUGGUGGGGUGGGUGCCUGUAAUUCCAGCUAGUUGGGA >hsa-mir-1269a MI0006406 (SEQ ID NO: 1469)
UGGAUUGCCUAGACCAGGGAAGCCAGUUGGCAUGGCUCAGUCCAAGUCUGACCACCUGAGGAAUGCCUGGACUGAGC
CGUGCUACUGGCUUCCCUGGUCUCCAGC >hsa-mir-1269b MI0016888 (SEQ ID NO: 1470)
UGAGGUUUCUGGACUGAGCCAUGCUACUGGCUUCUCUGGUUCUCCAGCUUACAGAUGGCUUAUCAUGGGACCUCU >hsa-mir-1270-1 MI0006407 (SEQ ID NO: 1471)
CACAGAGUUAUACUGGAGAUAUGGAAGAGCUGUGUUGGGUAUAAGUAACAGGCUUUUCUUUAUCUUCUAUGUGGCUC
UUUGCA >hsa-mir-1270-2 MI0015976 (SEQ ID NO: 1472)
CACAGAGUUAUACUGGAGAUAUGGAAGAGCUGUGUUGGGUAUAAGUAACAGGCUUUUCUUUAUCUUCUAUGUGGCUC
UUUGCA >hsa-mir-1271 MI0003814 (SEQ ID NO: 1473)
CACCCAGAUCAGUGCUUGGCACCUAGCAAGCACUCAGUAAAUAUUUGUUGAGUGCCUGCUAUGUGCCAGGCAUUGUG
CUGAGGGCU >hsa-mir-1272 MI0006408 (SEQ ID NO: 1474)
CCAGAUCAGAUCUGGGUGCGAUGAUGAUGGCAGCAAAUUCUGAAAACGUGCUCAGUGUCUUUAUAACAGGAAAGCCG
UAAACUUAGAAAUGUAGGCUGCAGCUCGUGUGCUCUGUGGUCUGGGCUGGUA >hsa-mir-1273a MI0006409 (SEQ ID NO: 1475)
UGAGGCAGGAGAAUUGCUUGAACCCGGGUGGUGGAGGUUGCAGUGAGCCAAGAUUGCGCCACUGCACUCCAGCCUGG
GCGACAAAGCAAGACUCUUUCUUGGA >hsa-mir-1273c MI0014171 (SEQ ID NO: 1476)
UGCAGCCUGGGCGACAAAACGAGACCCUGUCUUUUUUUUUUUCUGAGACAGAGUCUCGUUCUGUUGCCCAAGCUGGA >hsa-mir-1273d MI0014254 (SEQ ID NO: 1477)
GAAUCGCUUGAACCCAUGAGGUUGAGGCUGCAGUGAGCCAAGAUCGUGCCACUGCACUUCAGCCUGGGUGACAAGAG
CGAAACUUC >hsa-mir-1273e MI0016059 (SEQ ID NO: 1478)
UGAGGCAGGAGAAUUGCUUGAACCCAGGAAGUGGAGGCUGCAGUGAGCCGAGAUCGAGCCACUGUACUCCAGCCUGG
GUGACACAGCGAGACUCCAGUCUCA >hsa-mir-1273f MI0018002 (SEQ ID NO: 1479)
AGGUGGGAGGAUUGCUUGAGCCUGGGAGAUGGAGGUUGCAGUGAGCUGAGAUCACGCAACUGCACCCCCAGCCUGGG
CCAUAGAGUCAGUCCUUGUCUC >hsa-mir-1273g MI0018003 (SEQ ID NO: 1480)
GAGGUGGGAGGAUUGCUUGAGUCAGGGUGGUUGAGGCUGCAGUAAGUUGUGAUCAUACCACUGCACUCCAGCCUGAG
UGACAGAGCAAGACCUUGUCUCA >hsa-mir-1275 MI0006415 (SEQ ID NO: 1481)
CCUCUGUGAGAAAGGGUGUGGGGGAGAGGCUGUCUUGUGUCUGUAAGUAUGCCAAACUUAUUUUCCCCAAGGCAGAG
GGA >hsa-mir-1276 MI0006416 (SEQ ID NO: 1482)
CCCCAGCUAGGUAAAGAGCCCUGUGGAGACACCUGGAUUCAGAGAACAUGUCUCCACUGAGCACUUGGGCCUUGAUG
GCGGCU >hsa-mir-1277 MI0006419 (SEQ ID NO: 1483)
ACCUCCCAAAUAUAUAUAUAUGUACGUAUGUGUAUAUAAAUGUAUACGUAGAUAUAUAUGUAUUUUGGUGGGUUU >hsa-mir-1278 MI0006425 (SEQ ID NO: 1484)
AUUUGCUCAUAGAUGAUAUGCAUAGUACUCCCAGAACUCAUUAAGUUGGUAGUACUGUGCAUAUCAUCUAUGAGCGA
AUAG >hsa-mir-1279 MI0006426 (SEQ ID NO: 1485)
AUAUUCACAAAAAUUCAUAUUGCUUCUUUCUAAUGCCAAGAAAGAAGAGUAUAAGAACUUCC >hsa-mir-1280 MI0006437 (SEQ ID NO: 1486)
UCUGUCCCACCGCUGCCACCCUCCCCUCUGCCUCAGUGUGCCAGGCAUCAGCACUCACUCACAGAGGCAGGCUGGAU
GGCGGGUGGGACAACAG >hsa-mir-1281 MI0006428 (SEQ ID NO: 1487)
AGGGGGCACCGGGAGGAGGUGAGUGUCUCUUGUCGCCUCCUCCUCCCCCUU >hsa-mir-1282 MI0006429 (SEQ ID NO: 1488)
CCUUCUUCUCGUUUGCCUUUUUCUGCUUCUGCUGCAUGAUCUCCGAGUCCCUGGGGGUAGAGAUGAUGGGGCACUGG
GAGGUACCAGAGGGCAAAAAGGAC >hsa-mir-1283-1 MI0003832 (SEQ ID NO: 1489)
CUCAAGCUAUGAGUCUACAAAGGAAAGCGCUUUCUGUUGUCAGAAAGAAGAGAAAGCGCUUCCCUUUUGAGGGUUAC
GGUUUGAGAA >hsa-mir-1283-2 MI0006430 (SEQ ID NO: 1490)
CUCAAGCUGUGAGUCUACAAAGGAAAGCGCUUUCUGUUGUCUGAAAGAAAGAAAUCGCUUCCCUUUGGAGUGUUAC
GGUUUGAGAA >hsa-mir-1284 MI0006431 (SEQ ID NO: 1491)
AUUUUGAUAUAUAAGCCAGUUUAAUGUUUUCUAUACAGACCCUGGCUUUUCUUAAAUUUUAUAUAUUGGAAAGCCCA
UGUUUGUAUUGGAAACUGCUGGUUUCUUUCAUACUGAAAAUCU >hsa-mir-1285-1 MI0006346 (SEQ ID NO: 1492)
UGUAGAGAUAGGAUCUCACUUUGUUGCCCAGGCUGGUCUCAAACUCCUGGUCUGGGCAACAAAGUGAGACCUUAUCU
CUACAAG >hsa-mir-1285-2 MI0006347 (SEQ ID NO: 1493)
UUUGGGAGGCCGAGGCUGGUGCAUCACUUGAGCCCAGCAAUUUGAGACCAAUCUGGGCAACAAAGUGAGACCUCCGU
CUCUACAAAGA >hsa-mir-1286 MI0006348 (SEQ ID NO: 1494)
UGUCCUCUGGGGACUCAGCUUGCUCUGGCUGCUGGAUUGAAUUAGCUGCAGGACCAAGAUGAGCCCUUGGUGGAGACA >hsa-mir-1287 MI0006349 (SEQ ID NO: 1495)
GUUGUGCUGUCCAGGUGCUGGAUCAGUGGUUCGAGUCUGAGCCUUUAAAAGCCACUCUAGCCACAGAUGCAGUGAUU
GGAGCCAUGACAA >hsa-mir-1288 MI0006432 (SEQ ID NO: 1496)
GAGGGUGUUGAUCAGCAGAUCAGGACUGUAACUCACCAUAGUGGUGGACUGCCCUGAUCUGGAGACCACUGCCUU >hsa-mir-1289-1 MI0006350 (SEQ ID NO: 1497)
UUCUCAAUUUUUAGUAGGAAUUAAAAACAAAACUGGUAAAUGCAGACUCUUGGUUUCCACCCCCAGAGAAUCCCUAA
ACCGGGGGUGGAGUCCAGGAAUCUGCAUUUUAGAAAGUACCCAGGGUGAUUCUGAUAAUUGGGAACA >hsa-mir-1289-2 MI0006351 (SEQ ID NO: 1498)
CCACGGUCCUAGUUAAAAAGGCACAUUCCUAGACCCUGCCUCAGAACUACUGAACAGAGUCACUGGGUGUGGAGUCC
AGGAAUCUGCAUUUUUACCCCUAUCGCCCCCGCC >hsa-mir-1290 MI0006352 (SEQ ID NO: 1499)
GAGCGUCACGUUGACACUCAAAAAGUUUCAGAUUUUGGAACAUUUCGGAUUUUGGAUUUUUGGAUCAGGGAUGCUCAA >hsa-mir-1291 MI0006353 (SEQ ID NO: 1500)
GGUAGAAUUCCAGUGGCCCUGACUGAAGACCAGCAGUUGUACUGUGGCUGUUGGUUUCAAGCAGAGGCCUAAAGGAC
UGUCUUCCUG >hsa-mir-1292 MI0006433 (SEQ ID NO: 1501)
CCUGGGAACGGGUUCCGGCAGACGCUGAGGUUGCGUUGACGCUCGCGCCCCGGCUCCCGUUCCAGG >hsa-mir-1293 MI0006355 (SEQ ID NO: 1502)
AGGUUGUUCUGGGUGGUCUGGAGAUUUGUGCAGCUUGUACCUGCACAAAUCUCCGGACCACUUAGUCUUUA >hsa-mir-1294 MI0006356 (SEQ ID NO: 1503)
CACCUAAUGUGUGCCAAGAUCUGUUCAUUUAUGAUCUCACCGAGUCCUGUGAGGUUGGCAUUGUUGUCUGGCAUUGU
CUGAUAUACAACAGUGCCAACCUCACAGGACUCAGUGAGGUGAAACUGAGGAUUAGGAAGGUGUA >hsa-mir-1295a MI0006357 (SEQ ID NO: 1504)
AGGACAUUUUGCCCAGAUCCGUGGCCUAUUCAGAAAUGUGGCCUGUGAUUAGGCCGCAGAUCUGGGUGAAAUGUCCU
CC >hsa-mir-1295b MI0019146 (SEQ ID NO: 1505)
CACCCAGAUCUGCGGCCUAAUCACAGGCCACAUUUCUGAAUAGGCCACGGAUCUGGGCAA >hsa-mir-1296 MI0003780 (SEQ ID NO: 1506)
ACCUACCUAACUGGGUUAGGGCCCUGGCUCCAUCUCCUUUAGGAAAACCUUCUGUGGGGAGUGGGGCUUCGACCCUA
ACCCAGGUGGGCUGU >hsa-mir-1297 MI0006358 (SEQ ID NO: 1507)
UGUUUAUCUCUAGGGUUGAUCUAUUAGAAUUACUUAUCUGAGCCAAAGUAAUUCAAGUAAUUCAGGUGUAGUGAAAC >hsa-mir-1298 MI0003938 (SEQ ID NO: 1508)
AGACGAGGAGUUAAGAGUUCAUUCGGCCUGUCCAGAUGUAUCCAAGUACCCUGUGUUAUUUGGCAAUAAAUACAUCUG
GGCAACUGACUGAACUUUUCACUUUUCAUGACUCA >hsa-mir-1299 MI0006359 (SEQ ID NO: 1509)
CCUCAUGGCAGUGUUCUGGAAUCCUACGUGAGGGACAAUCAUUCAGACCCACGUAGCAGUGUUCUGGAAUUCUGUGU
GAGGGA >hsa-mir-1301 MI0003815 (SEQ ID NO: 1510)
GGAUUGUGGGGGUCGCUCUAGGCACCGCAGCACUGUGCUGGGGAUGUUGCAGCUGCCUGGGAGUGACUUCACACAG
UCCUC >hsa-mir-1302-1 MI0006362 (SEQ ID NO: 1511)
CAGAAAGCCCAGUUAAAUUUGAAUUUCAGUAAACAAUGAAAAUAAUUGUGUAUGUAAGAAUAUCCCAUACAAUAUUUG
GGACAUACUUAUGCUAAAAAUUAUUCCUUGCUUAUCUGAAAAUUCAAAUGUAACUAGGAUUCCUGUA >hsa-mir-1302-10 MI0015979 (SEQ ID NO: 1512)
GGAUGCCCAGCUAGUUUGAAUUUUAGAUAAACAACGAAUAAUUUCGUAGCAUAAAUAUGUCCCAAGCUUAGUUUGGG
ACAUACUUAUGCUAAAAAACAUUAUUGGUUGUUUAUCUGAGAUUCAGAAUUAAGCAUUUUA >hsa-mir-1302-11 MI0015980 (SEQ ID NO: 1513)
GGAUGCCCAGCUAGUUUGAAUUUUAGAUAAACAACGAAUAAUUUCGUAGCAUAAAUAUGUCCCAAGCUUAGUUUGGG
ACAUACUUAUGCUAAAAAACAUUAUUGGUUGUUUAUCUGAGAUUCAGAAUUAAGCAUUUUA >hsa-mir-1302-2 MI0006363 (SEQ ID NO: 1514)
GGAUGCCCAGCUAGUUUGAAUUUUAGAUAAACAACGAAUAAUUUCGUAGCAUAAAUAUGUCCCAAGCUUAGUUUGGG
ACAUACUUAUGCUAAAAAACAUUAUUGGUUGUUUAUCUGAGAUUCAGAAUUAAGCAUUUUA >hsa-mir-1302-3 MI0006364 (SEQ ID NO: 1515)
GGAUGCCCAGCUAGUUUGAAUUUUAGAUAAACAACGAAUAAUUUCGUAGCAUAAAUAUUCCCAAGCUUAGUUUGGG
ACAUACUUAUGCUAAAAAACAUUAUUGGUUGUUUAUCUGAGAUUCAAAAUUAAGCAUUUUA >hsa-mir-1302-4 MI0006365 (SEQ ID NO: 1516)
AAUGCAGAAGCACAGCUAAAAUUUGAAUUUCAGAUAAACAAAUUUUUCUUAGAAUAAGUAUGUCUCCAUGCAACAUU
UGGGACAUACUUAUGCUAAAAUAUUAUUUGUGUUUCAUCUGAAAUUCAAAUUCAACUGGACAUCCUGUAUUUU >hsa-mir-1302-5 MI0006366 (SEQ ID NO: 1517)
UGCCCGGCCUCCCAUUAAAUUGGUUUUUCAGACAAAUCACAAAUUUGUUUAGGUAUAAGUAUAUCCCAUGUAAUCUU
UGGGACAUACUUAUGCUAAAAUAAUUGUUCCUUGUUGAUGGAAAUUUUAAUUUUAAUUAGGUGUCCUGUAUU >hsa-mir-1302-6 MI0006367 (SEQ ID NO: 1518)
AACAAAUAAUUUGGUAAUAUAUGUAUGGCCCACACAAUAUUUAGGACAACAAUAUUUGGGACAUACUUAUGCUAAAA
AAGUAUUUGUUGA >hsa-mir-1302-7 MI0006368 (SEQ ID NO: 1519)
ACAACAUGUUUUUAGGACAUGUAUGUCUGGUGCAAUAAUUGGGACAUACUUAUGCUAAAAAAAUUAGUGUUC >hsa-mir-1302-8 MI0006369 (SEQ ID NO: 1520)
CCCAUUUAAACUUGAAUUUCAUAUAAACACCGUAAUUUUCAGCAUUUAGUGUAUCACAUGCAGUAUUUGGGACAUACU
UAUGCUAAAAAAUUAGGUGGUGUUGAUCUGAAAUUCCAGUGUAGAUGGGCA >hsa-mir-1302-9 MI0015978 (SEQ ID NO: 1521)
GGAUGCCCAGCUAGUUUGAAUUUUAGAUAAACAACGAAUAAUUUCGUAGCAUAAAUAUGUCCCAAGCUUAGUUUGGG
ACAUACUUAUGCUAAAAAACAUUAUUGGUUGUUUAUCUGAGAUUCAGAAUUAAGCAUUUUA >hsa-mir-1303 MI0006370 (SEQ ID NO: 1522)
GGCUGGGCAACAUAGCGAGACCUCAACUCUACAAUUUUUUUUUUUAAAUUUUAGAGACGGGGUCUUGCUCUGUUG
CCAGGCUUU >hsa-mir-1304 MI0006371 (SEQ ID NO: 1523)
AAACACUUGAGCCCAGCGGUUUGAGGCUACAGUGAGAUGUGAUCCUGCCACAUCUCACUGUAGCCUCGAACCCCUGG
GCUCAAGUGAUUCA >hsa-mir-1305 MI0006372 (SEQ ID NO: 1524)
AAGAUCCUGCUGUUUCUACCAUUAGUUUUGAAUGUUUAUUGUAAAGAUACUUUUCAACUCUAAUGGGAGAGACAGCA
GGAUUCUCC >hsa-mir-1306 MI0006443 (SEQ ID NO: 1525)
GUGAGCAGUCUCCACCACCUCCCCUGCAAACGUCCAGUGGUGCAGAGGUAAUGGACGUUGGCUCUGGUGGUGAUGGA
CAGUCCGA >hsa-mir-1307 MI0006444 (SEQ ID NO: 1526)
CAUCAAGACCCAGCUGAGUCACUGUCACUGCCUACCAAUCUCGACCGGACCUCGACCGGCUCGUCUGUGUUGCCAAU
CGACUCGGCGUGGCGUCGGUCGUGGUAGAUAGGCGGUCAUGCAUACGAAUUUUCAGCUCUUGUUCGGUGAC >hsa-mir-1321 MI0006652 (SEQ ID NO: 1527)
ACAUUAUGAAGCAAGUAUUAUUAUCCCUGUUUUACAAAUAAGGAAAUAAACUCAGGGAGGUGAAUGUGAUCAAAGAU
AG >hsa-mir-1322 MI0006653 (SEQ ID NO: 1528)
AGUAUCAUGAAUUAGAAACCUACUUAUUACAUAGUUUACAUAAGAAGCGUGAUGAUGCUGCUGAUGCUGUA >hsa-mir-1323 MI0003786 (SEQ ID NO: 1529)
ACUGAGGUCCUCAAAACUGAGGGGCAUUUUCUGUGGUUUGAAAGGAAAGUGCACCCAGUUUUGGGGAUGUCAA >hsa-mir-1324 MI0006657 (SEQ ID NO: 1530)
CCUGAAGAGGUGCAUGAAGCCUGGUCCUGCCCUCACUGGGAACCCCCUUCCCUCUGGGUACCAGACAGAAUUCUAUG
CACUUUCCUGGAGGCUCCA >hsa-mir-1343 MI0017320 (SEQ ID NO: 1531)
GCUGGCGUCGUGCUGGGGAGCGGCCCCCGGGUGGGCCUCUGCUCUGGCCCCUCCUGGGGCCCGCACUCUCGCUCUG
GGCCCGC >hsa-mir-1468 MI0003782 (SEQ ID NO: 1532)
GGUGGGUGGUUUCUCCGUUUGCCUGUUUCGCUGAUGUGCAUUCAACUCAUUCUCAGCAAAAUAAGCAAAUGGAAAU
UCGUCCAUC >hsa-mir-1469 MI0007074 (SEQ ID NO: 1533)
CUCGGCGCGGGCGCGGGCUCCGGGUUGGGGCGAGCCAACGCCGGGG >hsa-mir-1470 MI0007075 (SEQ ID NO: 1534)
GCCCUCCGCCCGUGCACCCCGGGGCAGGAGACCCCGCGGGACGCGCCGAGGUAGGGGGAC >hsa-mir-1471 MI0007076 (SEQ ID NO: 1535)
GCCCGCGUGUGGAGCCAGGUGUAGAGGCGGAGCACAGCUGGCUCUAAUUUGAGGGGC >hsa-mir-1537 MI0007258 (SEQ ID NO: 1536)
ACAGCUGUAAUUAGUCAGUUUUCUGUCCUGUCCACACAGAAAACCGUCUAGUUACAGUUGU >hsa-mir-1538 MI0007259 (SEQ ID NO: 1537)
GGGAACAGCAGCAACAUGGGCCUCGCUUCCUGCCGGCGCGGCCCGGGCUGCUGCUGUUCCU >hsa-mir-1539 MI0007260 (SEQ ID NO: 1538)
GGCUCUGCGGCCUGCAGGUAGCGCGAAAGUCCUGCGCGUCCCAGAUGCCC >hsa-mir-1587 MI0016905 (SEQ ID NO: 1539)
UUUGGGCUGGGCUGGGUUGGGCAGUUCUUCUGCUGGACUCACCUGUGACCAGC >hsa-mir-1825 MI0008193 (SEQ ID NO: 1540)
AGAGACUGGGGUGCUGGGCUCCCCUAGACUAGGACUCCAGUGCCCUCCUCUCC >hsa-mir-1827 MI0008195 (SEQ ID NO: 1541)
UCAGCAGCACAGCCUUCAGCCUAAAGCAAUGAGAAGCCUCUGAAAGGCUGAGGCAGUAGAUUGAAU >hsa-mir-1908 MI0008329 (SEQ ID NO: 1542)
CGGGAAUGCCGCGGCGGGGACGGCGAUUGGUCCGUAUGUGUGGUGCCACCGGCCGCCGGCUCCGCCCCGGCCCCGC
CCC >hsa-mir-1909 MI0008330 (SEQ ID NO: 1543)
CAUCCAGGACAAUGGUGAGUGCCGGUGCCUGCCCUGGGGCCGUCCCUGCGCAGGGGCCGGGUGCUCACCGCAUCUGC
CCC >hsa-mir-1910 MI0008331 (SEQ ID NO: 1544)
UGUCCCUUCAGCCAGUCCUGUGCCUGCCGCCUUUGUGCUGUCCUUGGAGGGAGGCAGAAGCAGGAUGACAAUGAGGG
CAA >hsa-mir-1911 MI0008332 (SEQ ID NO: 1545)
UCGGCAUCUGCUGAGUACCGCCAUGUCUGUUGGGCAUCCACAGUCUCCCACCAGGCAUUGUGGUCUCCGCUGACGCU
UUG >hsa-mir-1912 MI0008333 (SEQ ID NO: 1546)
CUCUAGGAUGUGCUCAUUGCAUGGGCUGUGUAUAGUAUUAUUCAAUACCCAGAGCAUGCAGUGUGAACAUAAUAGAG
AUU >hsa-mir-1913 MI0008334 (SEQ ID NO: 1547)
ACCUCUACCUCCCGGCAGAGGAGGCUGCAGAGGCUGGCUUUCCAAAACUCUGCCCCUCCGCUGCUGCCAAGUGGCU
GGU >hsa-mir-1914 MI0008335 (SEQ ID NO: 1548)
CGUGUGAGCCCGCCCUGUGCCCGGCCCACUUCUGCUUCCUCUUAGCGCAGGAGGGGUCCCGCACUGGGAGGGGCCCU
CAC >hsa-mir-1915 MI0008336 (SEQ ID NO: 1549)
UGAGAGGCCGCACCUUGCCUUGCUGCCCGGGCCGUGCACCCGUGGGCCCCAGGGCGACGCGGCGGGGCGGCCCUAG
CGA >hsa-mir-1972-1 MI0009982 (SEQ ID NO: 1550)
UAUAGGCAUGUGCCACCACACCUGGCUUAAAUGUGUCAUUUAAAAAUUCAGGCCAGGCACAGUGGCUCAUGCCUGUA >hsa-mir-1972-2 MI0015977 (SEQ ID NO: 1551)
UAUAGGCAUGUGCCACCACACCUGGCUUAAAUGUGUCAUUUAAAAAUUCAGGCCAGGCACAGUGGCUCAUGCCUGUA >hsa-mir-1973 MI0009983 (SEQ ID NO: 1552)
UAUGUUCAACGGCCAUGGUAUCCUGACCGUGCAAAGGUAGCAUA >hsa-mir-1976 MI0009986 (SEQ ID NO: 1553)
GCAGCAAGGAAGGCAGGGGUCCUAAGGUGUGUCCUCCUGCCCUCCUUGCUGU >hsa-mir-2052 MI0010486 (SEQ ID NO: 1554)
CUGUUUUGAUAACAGUAAUGUCCCUUUAGUUCAAAGUUACCAGCUAUCAAAACAA >hsa-mir-2053 MI0010487 (SEQ ID NO: 1555)
CUUGCCAUGUAAAUACAGAUUUAAUUAACAUUUGCAACCUGUGAAGAUGCAAAACUUUAAGUGUUAAUUAAACCUCU
AUUUACAUAGCAAG -continued >hsa-mir-2054 MI0010488 (SEQ ID NO: 1556)
CUGUAAUAUAAAUUUAAUUUAUUCUCUAUCAUUAAAAAAUGUAUUACAG >hsa-mir-2110 MI0010629 (SEQ ID NO: 1557)
CAGGGGUUUGGGGAAACGGCCGCUGAGUGAGGCGUCGGCUGUGUUUCUCACCGCGGUCUUUUCCUCCCACUCUUG >hsa-mir-2113 MI0003939 (SEQ ID NO: 1558)
UUUUCAAAGCAAUGUGUGACAGGUACAGGGACAAAUCCCGUUAAUAAGUAAGAGGAUUUGUGCUUGGCUCUGUCACA
UGCCACUUUGAAAA >hsa-mir-2114 MI0010633 (SEQ ID NO: 1559)
CCUCCAUGCUCCUAGUCCCUUCCUUGAAGCGGUCGGAUAAUCACAUGACGAGCCUCAAGCAAGGGACUUCAAGCUGG
UGG >hsa-mir-2115 MI0010634 (SEQ ID NO: 1560)
ACUGUCAUCCCACUGCUUCCAGCUUCCAUGACUCCUGAUGGAGGAAUCACAUGAAUUCAUCAGAAUUCAUGGAGGCU
AGAAGCAGUAUGAGGAUCAUUUA >hsa-mir-2116 MI0010635 (SEQ ID NO: 1561)
GACCUAGGCUAGGGGUUCUUAGCAUAGGAGGUCUUCCCAUGCUAAGAAGUCCUCCCAUGCCAAGAACUCCCAGACUA
GGA >hsa-mir-2117 MI0010636 (SEQ ID NO: 1562)
GCUCUGAUUUACUUCUGUCCGGCAUGGUGAACAGCAGGAUUGGCUGUAGCUGUUCUCUUUGCCAAGGACAGAUCGA
UCU >hsa-mir-2276 MI0011282 (SEQ ID NO: 1563)
GUGUUCUUCCAGUCCGCCCUCUGUCACCUUGCAGACGGCUUUCUCUCCGAAUGUCUGCAAGUGUCAGAGGCGAGGAG
UGGCAGCUGCAU >hsa-mir-2277 MI0011284 (SEQ ID NO: 1564)
GUGCUUCCUGCGGGCUGAGCGCGGGCUGAGCGCUGCCAGUCAGCGCUCACAUUAAGGCUGACAGCGCCCUGCCUGGC
UCGGCCGGCGAAGCUC >hsa-mir-2278 MI0011285 (SEQ ID NO: 1565)
GUGCUGCAGGUGUUGGAGAGCAGUGUGUGUUGCCUGGGGACUGUGUGGACUGGUAUCACCCAGACAGCUUGCACUGA
CUCCAGACCCUGCCGUCAU >hsa-mir-2355 MI0015873 (SEQ ID NO: 1566)
CAGACGUGUCAUCCCCAGAUACAAUGGACAAUAUGCUAUUAUAAUCGUAUGGCAUUGUCCUUGCUGUUUGGAGAUAA
UACUGCUGAC >hsa-mir-2392 MI0016870 (SEQ ID NO: 1567)
AUGGUCCCUCCCAAUCCAGCCAUUCCUCAGACCAGGUGGCUCCCGAGCCACCCCAGGCUGUAGGAUGGGGGUGAGAG
GUGCUAG >hsa-mir-2467 MI0017432 (SEQ ID NO: 1568)
GGACAGGCACCUGAGGCUCUGUUAGCCUUGGCUCUGGGUCCUGCUCCUUAGAGCAGAGGCAGAGAGGCUCAGGGUCU
GUCU >hsa-mir-2681 MI0012062 (SEQ ID NO: 1569)
GCCCCCUUUUCACGCAUUUGUGUUUUACCACCUCCAGGAGACUGCCCAAAGACUCUUCAGUAUCAUGGAGUUGGUAA
AGCACAGAUGCAUGAAUAAUUCAACGUG >hsa-mir-2682 MI0012063 (SEQ ID NO: 1570)
ACCUUCCUGAAAGAGGUUGGGGCAGGCAGUGACUGUUCAGACGUCCAAUCUCUUUGGGACGCCUCUUCAGCGCUGUC
UUCCCUGCCUCUGCCUUUAGGACGAGUCUCAAA >hsa-mir-2861 MI0013006 (SEQ ID NO: 1571)
GGCGCCUCUGCAGCUCCGGCUCCCCCUGGCCUCUCGGGAACUACAAGUCCCAGGGGGCCUGGCGGUGGGCGGCGGGC
GGAAGAGGCGGGG >hsa-mir-2909 MI0013083 (SEQ ID NO: 1572)
GGUGUUAGGGCCAACAUCUCUUGGUCUUUCCCCUGUGGUCCCAAGAUGGCUGUUGCAACUUAACGCCAU >hsa-mir-2964a MI0017299 (SEQ ID NO: 1573)
GGAGCUCAGCCACAGAUGUCCAGCCACAAUUCUCGGUUGGCCGCAGACUCGUACAAGAAUUGCGUUUGGACAAUCAG
UGGCGAAGCCC >hsa-mir-3064 MI0017375 (SEQ ID NO: 1574)
GGUCUGGCUGUUGUGGGUGUGCAAAACUCCGUACAUUGCUAUUUUGCCACACUGCAACACCUUACAG >hsa-mir-3065 MI0014228 (SEQ ID NO: 1575)
CUGCCCUCUUCAACAAAAUCACUGAUGCUGGAGUCGCCUGAGUCAUCACUCAGCACCAGGAUAUUGUUGGAGAGGAC
AG >hsa-mir-3074 MI0014181 (SEQ ID NO: 1576)
GCUCGACUCCUGUUCCUGCUGAACUGAGCCAGUGUGUAAAAUGAGAACUGAUAUCAGCUCAGUAGGCACCGGAGGGC
GGGU >hsa-mir-3115 MI0014127 (SEQ ID NO: 1577)
UCUGAAUAUGGGUUUACUAGUUGGUGGUGAAUUCAUGAGUCGCCAACUAUUAGGCCUUUAUGUCCAGA >hsa-mir-3116-1 MI0014128 (SEQ ID NO: 1578)
CUUUAUUGAGUCCCUACUAUGUUCCAGGCACUGGGUAUCGUAGGUGCCUGGAACAUAGUAGGGACUCAAUAAAG >hsa-mir-3116-2 MI0014129 (SEQ ID NO: 1579)
UAUUGAGUCCCUACUAUGUUCCAGGCACCUACGAUACCCAGUGCCUGGAACAUAGUAGGGACUCAAUA >hsa-mir-3117 MI0014130 (SEQ ID NO: 1580)
CCCUAAAGGGCCAGACACUAUACGAGUCAUAUAAGGGAAGGCAUUAUAGGACUCAUAUAGUGCCAGGUGUUUUGUGGG >hsa-mir-3118-1 MI0014131 (SEQ ID NO: 1581)
CACACUACAAUAAUUUUCAUAAUGCAAUCACACAUAAUCACUAUGUGACUGCAUUAUGAAAAUUCUUGUAGUGUG >hsa-mir-3118-2 MI0014132 (SEQ ID NO: 1582)
ACACUACAAUAAUUUUCAUAAUGCAAUCACACAUAAUCACUAUGUGACUGCAUUAUGAAAAUUCUUGUAGUGU >hsa-mir-3118-3 MI0014133 (SEQ ID NO: 1583)
CACACUACAAUAAUUUUCAUAAUGCAAUCACACAUAAUCACUAUGUGACUGCAUUAUGAAAAUUCUUGUAGUGUG >hsa-mir-3118-4 MI0014207 (SEQ ID NO: 1584)
CAUACUACAAUAAUUUUCAUAAUGCAAUCACACACAAUCACCGUGUGACUGCAUUAUGAAAAUUCUUCUAGUGUG >hsa-mir-3118-5 MI0014243 (SEQ ID NO: 1585)
CACACAUACAAUAAUAUUCAUAAUGCAAUCACACACAAUCACCAUGUGACUGCAUUAUGAAAAUUCUUCUAGUGUG >hsa-mir-3118-6 MI0015981 (SEQ ID NO: 1586)
CAUACUACAAUAAUUUUCAUAAUGCAAUCACACACAAUCACCGUGUGACUGCAUUAUGAAAAUUCUUCUAGUGUG >hsa-mir-3119-1 MI0014134 (SEQ ID NO: 1587)
AUUAACUCUGGCUUUUAACUUUGAUGGCAAAGGGGUAGCUAAACAAUCUAUGUCUUUGCCAUCAAAGUUAAAAGCCAUAGUUAAU >hsa-mir-3119-2 MI0014135 (SEQ ID NO: 1588)
AUUAACUAUGGCUUUUAACUUUGAUGGCAAAGACAUAGAUUGUUUAGCUACCCCUUUGCCAUCAAAGUUAAAAGCCAGAGUUAAU >hsa-mir-3120 MI0014136 (SEQ ID NO: 1589)
GUCAUGUGACUGCCUGUCUGUGCCUGCUGUACAGGUGAGCGGAUGUUCUGCACAGCAAGUGUAGACAGGCAGACACAUGAC >hsa-mir-3121 MI0014137 (SEQ ID NO: 1590)
AAAUGGUUAUGUCCUUUGCCUAUUCUAUUUAAGACACCCUGUACCUUAAAUAGAGUAGGCAAAGGACAGAAACAUUU >hsa-mir-3122 MI0014138 (SEQ ID NO: 1591)
ACCAGCUCUGUUGGGACAAGAGGACGGUCUUCUUUUGGAAGGAAGACCAUCAUCUUGUCCGAAGAGAGCUGGU >hsa-mir-3123 MI0014139 (SEQ ID NO: 1592)
AUGGAUUUGAUUGAAUGAUUCUCCCAUUUCCACAUGGAGAGUGGAGCCCAGAGAAUUGUUUAAUCAUGUAUCCAU >hsa-mir-3124 MI0014140 (SEQ ID NO: 1593)
GCGGGCUUCGCGGGCGAAGGCAAAGUCGAUUUCCAAAAGUGACUUUCCUCACUCCCGUGAAGUCGGC >hsa-mir-3125 MI0014142 (SEQ ID NO: 1594)
GAGAAUGGGUAGAGGAAGCUGUGGAGAGAACUCACGGUGCCUGUGGUUCGAGAUCCCCGCCUUCCUCCUCCUUUCCUC >hsa-mir-3126 MI0014143 (SEQ ID NO: 1595)
AUGAUUAUAUGAGGGACAGAUGCCAGAAGCACUGGUUAUGAUUUGCAUCUGGCAUCCGUCACACAGAUAAUUAU >hsa-mir-3127 MI0014144 (SEQ ID NO: 1596)
GGCCAGGCCCAUCAGGGCUUGUGGAAUGGGAAGGAGAAGGGACGCUUCCCCUUCUGCAGGCCUGCUGGGUGUGGCU >hsa-mir-3128 MI0014145 (SEQ ID NO: 1597)
UUCCUCUGGCAAGUAAAAAACUCUCAUUUUCCUUAAAAAAUGAGAGUUUUUUACUUGCAAUAGGAA >hsa-mir-3129 MI0014146 (SEQ ID NO: 1598)
GUACUUGGGCAGUAGUGUAGAGAUUGGUUUGCCUGUUAAUGAAUUCAAACUAAUCUCUACACUGCUGCCCAAGAGC >hsa-mir-3130-1 MI0014147 (SEQ ID NO: 1599)
CUUGUCAUGUCUUACCCAGUCUCCGGUGCAGCCUGUUUGUCAAGGCUGCACCGGAGACUGGGUAAGACAUGACAAG >hsa-mir-3130-2 MI0014148 (SEQ ID NO: 1600)
CUUGUCAUGUCUUACCCAGUCUCCGGUGCAGCCUUGACAACAGGCUGCACCGGAGACUGGGUAAGACAUGACAAG >hsa-mir-3131 MI0014151 (SEQ ID NO: 1601)
GAGUCGAGGACUGGUGGAAGGGCCUUUCCCCUCAGACCAAGGCCCUGGCCCCAGCUUCUUCUC -continued >hsa-mir-3132 MI0014152 (SEQ ID NO: 1602)
GGUGGGAUGGGUAGAGAAGGAGCUCAGAGGACGGUGCGCCUUGUUUCCCUUGAGCCCUCCCUCUCUAUCCCACC >hsa-mir-3133 MI0014153 (SEQ ID NO: 1603)
CAGAAAUUGUAAAGAACUCUUAAAACCCAAUAGUAAAAAGACAACCUGUUGAGUUUUAAGAGUUCUUUAUAUAUUCUG >hsa-mir-3134 MI0014155 (SEQ ID NO: 1604)
UGUAUCCAAUGUGUAGUCUUUUAUCCCUCACAUGGAGUAAAAUAUGAUGGAUAAAAGACUACAUAUUGGGUACA >hsa-mir-3135a MI0014156 (SEQ ID NO: 1605)
UCACUUUGGUGCCUAGGCUGAGACUGCAGUGGUGCAAUCUCAGUUCACUGCAGCCUUGACCUCCUGGGCUCAGGUGA >hsa-mir-3135b MI0016809 (SEQ ID NO: 1606)
UGCCCAGGCUGGAGCGAGUGCAGUGGUGCAGUCAGUCCUAGCUCACUGCAGCCUCGAACUCCUGGGCU >hsa-mir-3136 MI0014158 (SEQ ID NO: 1607)
AAUAUGAAACUGACUGAAUAGGUAGGGUCAUUUUUCUGUGACUGCACAUGGCCCAACCUAUUCAGUUAGUUCCAUAUU >hsa-mir-3137 MI0014160 (SEQ ID NO: 1608)
UACAGGUCUGUAGCCUGGGAGCAAUGGGGUGUAUGGUAUAGGGGUAGCCUCGUGCUCCUGGGCUACAAACCUGUA >hsa-mir-3138 MI0014161 (SEQ ID NO: 1609)
CCCUCCUCGGCACUUCCCCCACCUCACUGCCCGGGUGCCCACAAGACUGUGGACAGUGAGGUAGAGGGAGUGCCGAG
GAGGG >hsa-mir-3139 MI0014162 (SEQ ID NO: 1610)
GGCUCAGAGUAGGAGCUCAACAGAUGCCUGUUGACUGAAUAAUAAACAGGUAUCGCAGGAGCUUUUGUUAUGUGCC >hsa-mir-3140 MI0014163 (SEQ ID NO: 1611)
CCUCUUGAGGUACCUGAAUUACCAAAAGCUUUAUGUAUUCUGAAGUUAUUGAAAAUAAGAGCUUUUGGGAAUUCAGG
UAGUUCAGGAGUG >hsa-mir-3141 MI0014165 (SEQ ID NO: 1612)
UCACCCGGUGAGGGCGGGUGGAGGAGGAGGGUCCCCACCAUCAGCCUUCACUGGGACGGGA >hsa-mir-3142 MI0014166 (SEQ ID NO: 1613)
UUCAGAAAGGCCUUUCUGAACCUUCAGAAAGGCUGCUGAAUCUUCAGAAAGGCCUUUCUGAACCUUCAGAAAGGCUG
CUGAA >hsa-mir-3143 MI0014167 (SEQ ID NO: 1614)
UAGAUAACAUUGUAAAGCGCUUCUUUCGCGGUUGGGCUGGAGCAACUCUUUACAAUGUUUCUA >hsa-mir-3144 MI0014169 (SEQ ID NO: 1615)
AACUACACUUUAAGGGGACCAAAGAGAUAUAUAGAUAUCAGCUACCUAUAUACCUGUUCGGUCUCUUUAAAGUGUAG
UU >hsa-mir-3145 MI0014170 (SEQ ID NO: 1616)
UAUAUGAGUUCAACUCCAAACACUCAAAACUCAUUGUUGAAUGGAAUGAGAUAUUUUGAGUGUUUGGAAUUGAACUC
GUAUA >hsa-mir-3146 MI0014172 (SEQ ID NO: 1617)
GCUAAGUCCCUUCUUUCUAUCCUAGUAUAACUUGAAGAAUUCAAAUAGUCAUGCUAGGAUAGAAAGAAUGGGACUUG
GC >hsa-mir-3147 MI0014173 (SEQ ID NO: 1618)
GUCCGGGUUGGGCAGUGAGGAGGGUGUGACGCCGCGAAGUGCACCUCGCCCUUGUCCAACUCGGAC >hsa-mir-3148 MI0014175 (SEQ ID NO: 1619)
GAGUUAAGAUGGAAAAAACUGGUGUGUGCUUAUUGAUGUAGCCAACAAGCAUACAUCAGUUUUUUCCAACUUAACUC >hsa-mir-3149 MI0014176 (SEQ ID NO: 1620)
AUACAUACAUGUACACACACAUGUCAUCCACACACAUACAUAUAUAUGUUUGUAUGGAUAUGUGUGUGUAUGUGU
GUGUAU >hsa-mir-3150a MI0014177 (SEQ ID NO: 1621)
GGGAAGCAGGCCAACCUCGACGAUCUCCCAGCACCUGAACGCCAAGGCUGGGGAGAUCCUCGAGGUUGGCCUGCUU
UCC >hsa-mir-3150b MI0016426 (SEQ ID NO: 1622)
GAGGGAAAGCAGGCCAACCUCGAGGAUCUCCCCAGCCUUGGCGUUCAGGUGCUGAGGAGAUCGUCGAGGUUGGCCUG
CUUCCCCUC >hsa-mir-3151 MI0014178 (SEQ ID NO: 1623)
GGGGUGAUGGGUGGGGCAAUGGGAUCAGGUGCCUCAAAGGGCAUCCCACCUGAUCCCACAGCCCACCUGUCACCCC >hsa-mir-3152 MI0014179 (SEQ ID NO: 1624)
GUGCAGAGUUAUUGCCUCUGUUCUAACACAAGACUAGGCUUCCCUGUGUUAGAAUAGGGGCAAUAACUCUGCAC >hsa-mir-3153 MI0014180 (SEQ ID NO: 1625)
GACAAAUUUUAAAUGUCCCUGUCCCCUUCCCCCCAAUUAAAGUAGAUUGGGGGAAAGCGAGUAGGGACAUUUAAAAU
UUGUU >hsa-mir-3154 MI0014182 (SEQ ID NO: 1626)
GGCCCCUCCUUCUCAGCCCCAGCUCCCGCUCACCCCUGCCACGUCAAAGGAGGCAGAAGGGGAGUUGGGAGCAGAGA
GGGGACC >hsa-mir-3155a MI0014183 (SEQ ID NO: 1627)
UCCGGGCAUCACCUCCCACUGCAGAGCCUGGGGAGCCGGACAGCUCCCUUCCCAGGCUCUGCAGUGGGAACUGAUGC
CUGGA >hsa-mir-3155b MI0016839 (SEQ ID NO: 1628)
CCACUGCAGAGCCUGGGAAGGGAGCUGUCCGGCUCCCCAGGCUCUGCAGUGGGAGU >hsa-mir-3156-1 MI0014184 (SEQ ID NO: 1629)
GCAGAAGAAAGAUCUGGAAGUGGGAGACACUUUUACUAUAUAUAGUGGCUCCCACUUCCAGAUCUUUCUCUCUGU >hsa-mir-3156-2 MI0014230 (SEQ ID NO: 1630)
UGCAGAAGAAAGAUCUGGAAGUGGGAGACACUUUCACUAUAUAUAGUGGCUCCCACUUCCAGAUCUUUCUCUCUGUA >hsa-mir-3156-3 MI0014242 (SEQ ID NO: 1631)
UGCAGAAGAAAGAUCUGGAAGUGGGAGACACUUUCACUAUAUAUAGUGGCUCCCACUUCCUGAUCUUUCUCUCUGUA >hsa-mir-3157 MI0014185 (SEQ ID NO: 1632)
GGGAAGGGCUUCAGCCAGGCUAGUGCAGUCUGCUUUGUGCCAACACUGGGGUGAUGACUGCCCUAGUCUAGCUGAAG
CUUUUCCC >hsa-mir-3158-1 MI0014186 (SEQ ID NO: 1633)
AUUCAGGCCGGUCCUGCAGAGAGGAAGCCCUUCUGCUUACAGGUAUUGGAAGGGCUUCCUCUCUGCAGGACCGGCCU
GAAU >hsa-mir-3158-2 MI0014187 (SEQ ID NO: 1634)
AUUCAGGCCGGUCCUGCAGAGAGGAAGCCCUUCCAAUACCUGUAAGCAGAAGGGCUUCCUCUCUGCAGGACCGGCCU
GAAU >hsa-mir-3159 MI0014188 (SEQ ID NO: 1635)
CCAAAGUCCUAGGAUUACAAGUGUCGGCCACGGGCUGGGCACAGUGGCUCACGCCUGUAAUCCCAGCAUUUUGG >hsa-mir-3160-1 MI0014189 (SEQ ID NO: 1636)
GGACCUGCCCUGGGCUUUCUAGUCUCAGCUCUCCUCCAGCUCAGCUGGUCAGGAGAGCUGAGACUAGAAAGCCCAGG
GCAGGUUC >hsa-mir-3160-2 MI0014190 (SEQ ID NO: 1637)
ACCUGCCCUGGGCUUUCUAGUCUCAGCUCUCCUGACCAGCUGAGCUGGAGGAGAGCUGAGACUAGAAAGCCCAGGGC
AGGU >hsa-mir-3161 MI0014191 (SEQ ID NO: 1638)
CCUCGAGAGCUGAUAAGAACAGAGGCCCAGAUUGAAGUUGAAUAGUGCUGGGCCUUUGUUUUUACCAAGUUCCCUGG >hsa-mir-3162 MI0014192 (SEQ ID NO: 1639)
CUGACUUUUUAGGGAGUAGAAGGGUGGGGAGCAUGAACAAUGUUUCUCACUCCCUACCCCUCCACUCCCCAAAAAA
GUCAG >hsa-mir-3163 MI0014193 (SEQ ID NO: 1640)
UUCCUCAUCUAUAAAAUGAGGGCAGUAAGACCUUCCUUCCUUGUCUUACUACCCCCAUUUUAUAGAUGAGGAA >hsa-mir-3164 MI0014194 (SEQ ID NO: 1641)
CUUGGAAACUGUGACUUUAAGGGAAAUGGCGCACAGCAGACCCUGCAAUCAUGCCGUUUUGCUUGAAGUCGCAGUUU
CCCAGG >hsa-mir-3165 MI0014195 (SEQ ID NO: 1642)
CCGGUGGCAAGGUGGAUGCAAUGUGACCUCAACUCUUGGUCCUCUGAGGUCACAUUGUAUCCACCUUACCACUGG >hsa-mir-3166 MI0014196 (SEQ ID NO: 1643)
AAAUUUUUUGAGGCCAGUAGGCAUUGUCUGCGUUAGGAUUUCUGUAUCAUCCUCCUAACGCAGACAAUGCCUACUG
GCCUAAGAAAAAUUU >hsa-mir-3167 MI0014198 (SEQ ID NO: 1644)
GGCUGUGGAGGCACCAGUAUUUCUGAAAUUCUUUUUUCUGAAAUUCUUCAGGAAGGAUUUCAGAAAUACUGGUGUCC
CGACAGCC >hsa-mir-3168 MI0014199 (SEQ ID NO: 1645)
AAGAUCAUGAGUUCUACAGUCAGACAGCCUGAGUUGGAGGCUCAUCUUCACUUCUUGCUGUGUGACCCUGGGCCAGU
GACUU >hsa-mir-3169 MI0014200 (SEQ ID NO: 1646)
AUGUGAAAACAUAGGACUGUGCUUGGCACAUAGCACAAAGUCUUAUGGUACUGUGUGCCAAGCAUAGUCCUGUGUUU
UUACAU >hsa-mir-3170 MI0014201 (SEQ ID NO: 1647)
CUGGUAACACUGGGGUUCUGAGACAGACAGUGUUAGCUCCAGAAGCAUUGCCUGUCUUAGAACCCCUAUGUUACCAG >hsa-mir-3171 MI0014202 (SEQ ID NO: 1648)
UAUAUAUAGAGAUGUAUGGAAUCUGUAUAUAUCUAUAUAUAUGUGUAUAUAUAGAUUCCAUAAAUCUAUAUAUG >hsa-mir-3173 MI0014204 (SEQ ID NO: 1649)
UCCCUGCCCUGCCUGUUUUCUCCUUUGUGAUUUUAUGAGAACAAAGGAGGAAAUAGGCAGGCCAGGGA >hsa-mir-3174 MI0014208 (SEQ ID NO: 1650)
GUUACCUGGUAGUGAGUUAGAGAUGCAGAGCCCUGGGCUCCUCAGCAAACCUACUGGAUCUGCAUUUUAAUUCACAU
GCAUGGUAAU >hsa-mir-3175 MI0014209 (SEQ ID NO: 1651)
CCUGGGGGGCGGGGAGAGAACGCAGUGACGUCUGGCCGCGUGCGCAUGUCGGGCGCUUUCUCCUCCCCCUACCCAGG >hsa-mir-3176 MI0014210 (SEQ ID NO: 1652)
UGGCCUCUCCAGUCUGCAGCUCCCGGCAGCCUCGGGCCACACUCCCGGGAUCCCCAGGGACUGGCCUGGGACUACCG
GGGGUGGCGGCCG >hsa-mir-3177 MI0014211 (SEQ ID NO: 1653)
CCACGUGCCAUGUGUACACACGUGCCAGGCGCUGUCUUGAGACAUUCGCGCAGUGCACGGCACUGGGGACACGUGGC
ACUGG >hsa-mir-3178 MI0014212 (SEQ ID NO: 1654)
GAGGCUGGGCGGGGCGCGGCCGGAUCGGUCGAGAGCGUCCUGGCUGAUGACGGUCUCCCGUGCCCACGCCCCAAACG
CAGUCUC >hsa-mir-3179-1 MI0014213 (SEQ ID NO: 1655)
CAGGAUCACAGACGUUUAAAUUACACUCCUUCUGCUGUGCCUUACAGCAGUAGAAGGGGUGAAAUUUAAACGUCUGU
GAUCCUG >hsa-mir-3179-2 MI0014216 (SEQ ID NO: 1656)
CAGGAUCACAGACGUUUAAAUUACACUCCUUCUGCUGUGCCUUACAGCAGUAGAAGGGGUGAAAUUUAAACGUCUGU
GAUCCUG >hsa-mir-3179-3 MI0014221 (SEQ ID NO: 1657)
CAGGAUCACAGACGUUUAAAUUACACUCCUUCUGCUGUGCCUUACAGCAGUAGAAGGGGUGAAAUUUAAACGUCUGU
GAUCCUG >hsa-mir-3180-1 MI0014214 (SEQ ID NO: 1658)
CAGUGCGACGGGCGGAGCUUCCAGACGCUCCGCCCCACGUCGCAUGCGCCCCGGGAAAGCGUGGGGCGGAGCUUCCG
GAGGCCCCGCCCUGCUG >hsa-mir-3180-2 MI0014215 (SEQ ID NO: 1659)
GCGACGGGCGGAGCUUCCAGACGCUCCGCCCCACGUCGCAUGCGCCCCGGGAAAGCGUGGGGCGGAGCUUCCGGAGG
CCCCGCCCUGC >hsa-mir-3180-3 MI0014217 (SEQ ID NO: 1660)
CAGUGCGACGGGCGGAGCUUCCAGACGCUCCGCCCCACGUCGCAUGCGCCCCGGGAAAGCGUGGGGCGGAGCUUCCG
GAGGCCCCGCCCUGCUG >hsa-mir-3180-4 MI0016408 (SEQ ID NO: 1661)
GCUCCGCCCCACGUCGCAUGCGCCCCGGGAACGCGUGGGGCGGAGCUUCGGAGGCCCCGCUCUGCUGCCGACCCUG
UGGAGCGGAGGGUGAAGCCUCCGGAUGCCAGUCCCUCAUCGCUGGCCUGGUCGCGCUGUGGCGAAGGGGCGGAGC >hsa-mir-3180-5 MI0016409 (SEQ ID NO: 1662)
GCUCCGCCCCACGUCGCAUGCGCCCCGGGAACGCGUGGGGCGGAGCUUCGGAGGCCCCGCCCUGCUGCCGACCCUG
UGGAGCGGAGGGUGAAGCCUCCGGAUGCCAGUCCCUCAUCGCUGGCCCGGUCGCGCUGUGGCGAAGGGGCGGAGC >hsa-mir-3181 MI0014223 (SEQ ID NO: 1663)
CGGCGACCAUCGGGCCCUCGGCGCCGGCCCGUUAGUUGCCCGGGCCCGAGCCGGCCGGGCCCGCGGGUUGCCG >hsa-mir-3182 MI0014224 (SEQ ID NO: 1664)
GCUGCUUCUGUAGUGUAGUCCGUGCAUCCGCCCUUCGAUGCUUGGGUUGGAUCAUAGAGCAGU >hsa-mir-3183 MI0014225 (SEQ ID NO: 1665)
CUCUGCCCUGCCUCUCUCGGAGUCGCUCGGAGCAGUCACGUUGACGGAAUCCUCCGGCGCCUCCUCGAGGGAGGAGA
GGCAGGG >hsa-mir-3184 MI0014226 (SEQ ID NO: 1666)
AAGCAAGACUGAGGGGCCUCAGACCGAGCUUUUGGAAAAUAGAAAAGUCUCGCUCUCUGCCCCUCAGCCUAACUU >hsa-mir-3185 MI0014227 (SEQ ID NO: 1667)
GAAUGGAAGAAGAAGGCGGUCGGUCUGCGGGAGCCAGGCCGCAGAGCCAUCCGCCUUCUGUCCAUGUC >hsa-mir-3186 MI0014229 (SEQ ID NO: 1668)
AGCCUGCGGUUCCAACAGGCGUCUGUCUACGUGGCUUCAACCAAGUUCAAAGUCACGCGGAGAGAUGGCUUUGGAAC
CAGGGGCU >hsa-mir-3187 MI0014231 (SEQ ID NO: 1669)
GCUGGCCCUGGGCAGCGUGUGGCUGAAGGUCACCAUGUUCUCCUUGGCCAUGGGGCUGCGCGGGGCCAGC >hsa-mir-3188 MI0014232 (SEQ ID NO: 1670)
GGCGCCUCCUGCUCUGCUGUGCCGCCAGGGCCUCCCCUAGCGCGCCUUCUGGAGAGGCUUUGUGCGGAUACGGGGCU
GGAGGCCU >hsa-mir-3189 MI0014233 (SEQ ID NO: 1671)
GCCUCAGUUGCCCCAUCUGUGCCCUGGGUAGGAAUAUCCUGGAUCCCCUUGGGUCUGAUGGGGUAGCCGAUGC >hsa-mir-3190 MI0014235 (SEQ ID NO: 1672)
CUGGGGUCACCUGUCUGGCCAGCUACGUCCCCACGGCCCUUGUCAGUGUGGAAGGUAGACGGCCAGAGAGGUGACCC
CGG >hsa-mir-3191 MI0014236 (SEQ ID NO: 1673)
GGGGUCACCUCUCUGGCCGUCUACCUUCCACACUGACAAGGGCCGUGGGGACGUAGCUGGCCAGACAGGUGACCCC >hsa-mir-3192 MI0014237 (SEQ ID NO: 1674)
GGAAGGGAUUCUGGGAGGUUGUAGCAGUGGAAAAAGUUCUUUUCUUCCUCUGAUCGCCCUCUCAGCUCUUUCCUUCU >hsa-mir-3193 MI0014238 (SEQ ID NO: 1675)
UCCUGCGUAGGAUCUGAGGAGUGGACGAGUCUCAUUACCCAGCUCCUGAGCAGGA >hsa-mir-3194 MI0014239 (SEQ ID NO: 1676)
AGGUGGCAGGGCCAGCCACCAGGAGGGCUGCGUGCCACCCGGGCAGCUCUGCUGCUCACUGGCAGUGUCACCU >hsa-mir-3195 MI0014240 (SEQ ID NO: 1677)
CCGCAGCCGCCGCGCCGGGCCCGGGUUGGCCGCUGACCCCCGCGGGGCCCCCGGCGGCCGGGGCGGGGGCGGGGGCU
GCCCCGG >hsa-mir-3196 MI0014241 (SEQ ID NO: 1678)
GGGUGGGGGCGGGGCGGCAGGGGCCUCCCCCAGUGCCAGGCCCCAUUCUGCUUCUCUCCCAGCU >hsa-mir-3197 MI0014245 (SEQ ID NO: 1679)
GGCGAGGGGAGGCGCAGGCUCGGAAAGGCGCGCGAGGCUCCAGGCUCCUUCCCGAUCCACCGCUCUCCUCGCU >hsa-mir-3198-1 MI0014246 (SEQ ID NO: 1680)
GACUGUGCUCUCACUGUUCACCCAGCACUAGCAGUACCAGACGGUUCUGUGGAGUCCUGGGGAAUGGAGAGAGCACA
GUC >hsa-mir-3198-2 MI0017335 (SEQ ID NO: 1681)
GACUCUGCUCUCACUGUUCACCCAGCACUAGCAGUACCAGAUGGUUCUGUGGAGUCCUGGGGAAUGGAGAGAGCACA
GUC >hsa-mir-3199-1 MI0014247 (SEQ ID NO: 1682)
GGUGACUCCAGGGACUGCCUUAGGAGAAAGUUUCUGGAAGUUCUGACAUUCCAGAAACUUUCUCCUAAGGCAGUCCC
UGGGAGUCACU >hsa-mir-3199-2 MI0014248 (SEQ ID NO: 1683)
GUGACUCCCAGGGACUGCCUUAGGAGAAAGUUUCUGGAAUGUCAGAACUUCCAGAAACUUUCUCCUAAGGCAGUCCC
UGGAGUCAC >hsa-mir-3200 MI0014249 (SEQ ID NO: 1684)
GGUGGUCGAGGGAAUCUGAGAAGGCGCACAAGGUUUGUGUCCAAUACAGUCCACACCUUGCGCUACUCAGGUCUGCU
CGUGCCCU >hsa-mir-3201 MI0014250 (SEQ ID NO: 1685)
GGGAUAUGAAGAAAAAUAAGAGGCUAGGAUUGCCUCUUAUUUUUACAUGCCC >hsa-mir-3202-1 MI0014252 (SEQ ID NO: 1686)
UAUUAAUAUGGAAGGGAGAAGAGCUUUAAUGAUUGGAGUCAUUUUCAGAGCAUUAAAGCUCUUCUCCCUUCCAUAUU
AAUG >hsa-mir-3202-2 MI0014253 (SEQ ID NO: 1687)
AUUAAUAUGGAAGGGAGAAGAGCUUUAAUGCUCUGAAAAUGACUCCAAUCAUUAAAGCUCUUCUCCCUUCCAUAUUA
AU >hsa-mir-3529 MI0017351 (SEQ ID NO: 1688)
GGCACCAUUAGGUAGACUGGGAUUUGUUGUUGAGCGCAGUAAGACAACAACAAAAUCACUAGUCUUCCAGAUGGGGCC >hsa-mir-3545 MI0017343 (SEQ ID NO: 1689)
GCGCCCGCCGGGUCUAGUGGUCCUAAACAUUUCACAAUUGCGCUACAGAACUGUUGAACUGUUAAGAACCACUGGAC
CCAGCGCGC >hsa-mir-3591 MI0017383 (SEQ ID NO: 1690)
CAGUAGCUAUUUAGUGUGAUAAUGGCGUUUGAUAGUUUAGACACAAACACCAUUGUCACACUCCACAGCUCUG >hsa-mir-3605 MI0015995 (SEQ ID NO: 1691)
ACUUUAUACGUGUAAUUGUGAUGAGGAUGGAUAGCAAGGAAGCCGCUCCCACCUGACCCUCACGGCCUCCGUGUUAC
CUGUCCUCUAGGUGGGACGCUCG >hsa-mir-3606 MI0015996 (SEQ ID NO: 1692)
UUGUUGCUAUCUAGGUUAGUGAAGGCUAUUUUAAUUUUUUUAAAAUUUCUUUCACUACUUAGG >hsa-mir-3607 MI0015997 (SEQ ID NO: 1693)
AAGGUUGCGGUGCAUGUGAUGAAGCAAAUCAGUAUGAAUGAAUUCAUGAUACUGUAAACGCUUUCUGAUGUACUACU
CA >hsa-mir-3609 MI0015999 (SEQ ID NO: 1694)
GUAACAGUAACUUUUAUUCUCAUUUUCCUUUUCUCUACCUUGUAGAGAAGCAAAGUGAUGAGUAAUACUGGCUGGAG
CCC >hsa-mir-3610 MI0016000 (SEQ ID NO: 1695)
AAGAGCCGCGGCGUAACGGCAGCCAUCUUGUUUGUUUGAGUGAAUCGGAAAGGAGGCGCCGGCUGUGGCGGCG >hsa-mir-3611 MI0016001 (SEQ ID NO: 1696)
AGCAGGUCUAAUAAGAAUUUCUUUUUCUUCACAAUUAUGAAAGAAAAGAAAUUGUGAAGAAAGAAAUUCUUACUAGU
UUUGCU >hsa-mir-3612 MI0016002 (SEQ ID NO: 1697)
GGGACUGGGGAUGAGGAGGCAUCUUGAGAAAUGGAAGGAAUGGGAUCUACUUCCAGUUCACUAGAGGCGUCCUGACA
CCCCUAGCUC >hsa-mir-3613 MI0016003 (SEQ ID NO: 1698)
UGGUUGGGUUUGGAUUGUUGUACUUUUUUUUUUGUUCGUUGCAUUUUUAGGAACAAAAAAAAAAGCCCAACCCUUCA
CACCACUUCA >hsa-mir-3614 MI0016004 (SEQ ID NO: 1699)
GGUUCUGUCUUGGGCCACUUGGAUCUGAAGGCUGCCCCUUUGCUCUCUGGGGUAGCCUUCAGAUCUUGGUGUUUUGA
AUUCUUACU >hsa-mir-3615 MI0016005 (SEQ ID NO: 1700)
GACUCUGGGACGCUCAGACGCCGCGCGGGGCGGGAUUGGUCUGUGGUCCUCUCUCGGCUCCUCGCGGCUCGCGGCG
GCCGACGGUU >hsa-mir-3616 MI0016006 (SEQ ID NO: 1701)
UGUCACUCCGCCAGCAUCAUGAAGUGCACUCAUGAUAUGUUUGCCCCAUCAGCGUGUCACGAGGGCAUUUCAUGAUG
CAGGCGGGGUUGGCA >hsa-mir-3617 MI0016007 (SEQ ID NO: 1702)
AGGUCAUAGAAAGACAUAGUUGCAAGAUGGGAUUAGAAACCAUAUGUCUCAUCAGCACCCUAUGUCCUUUCUCUGCC
CU >hsa-mir-3618 MI0016008 (SEQ ID NO: 1703)
UAAGCUGAGUGCAUUGUGAUUUCCAAUAAUUGAGGCAGUGGUUCUAAAAGCUGUCUACAUUAAUGAAAAGAGCAAUG
UGGCCAGCUUG >hsa-mir-3619 MI0016009 (SEQ ID NO: 1704)
ACGGCAUCUUUGCACUCAGCAGGCAGGCUGGUGCAGCCCGUGGUGGGGGACCAUCCUGCCUGCUGUGGGGUAAGGAC
GGCUGU >hsa-mir-3620 MI0016011 (SEQ ID NO: 1705)
GUGAGGUGGGGGCCAGCAGGGAGUGGGCUGGGCUGGGCUGGGCCAAGGUACAAGGCCUCACCCUGCAUCCCGCACCC
AG >hsa-mir-3621 MI0016012 (SEQ ID NO: 1706)
GUGAGCUGCUGGGGACGCGGGUCGGGUCUGCAGGGCGGUGCGGCAGCCGCCACCUGACGCCGCGCCUUUGUCUGUG
UCCCACAG >hsa-mir-3622a MI0016013 (SEQ ID NO: 1707)
AAUAGAGGGUGCACAGGCACGGGAGCUCAGGUGAGGCAGGGAGCUGAGCUCACCUGACCUCCCAUGCCUGUGCACCC
UCUAUU >hsa-mir-3622b MI0016014 (SEQ ID NO: 1708)
AGUGAUAUAAUAGAGGGUGCACAGGCAUGGGAGGUCAGGUGAGCUCAGCUCCCUGCCUCACCUGAGCUCCCGUGCCU
GUGCACCCUCUAUUGGCU >hsa-mir-3646 MI0016046 (SEQ ID NO: 1709)
UUCAGUAGGUUGGGUUCAUUUCAUUUUCAUGACAACCCUAUAUGGGAAAAUGUUGUGAAAAUGAAAUGAGCCCAGCC
CAUUGAA >hsa-mir-3648 MI0016048 (SEQ ID NO: 1710)
CGCGACUGCGGCGGCGUGGUGGGGGAGCCGCGGGGAUCGCCGAGGGCCGGUCGGCCGCCCCGGGUGCCGCGCGGU
GCCGCCGGCGGCGGUGAGGCCCCGCGCGUGUGUCCCGGCUGCGGUCGGCCGCGCUCGAGGGGUCCCCGUGGCGUCCC
CUUCCCCGCCGGCCGCCUUUCUCGCG >hsa-mir-3649 MI0016049 (SEQ ID NO: 1711)
GCUUGGAACAGGCACCUGUGUGUGCCCAAGUGUUUCUAGCAAACACAGGGACCUGAGUGUCUAAGC >hsa-mir-3650 MI0016050 (SEQ ID NO: 1712)
UCAAGGUGUGUCUGUAGAGUCCUGACUGCGUGCCAGGGGCUCUGUCUGGCACAUUUCUGA >hsa-mir-3651 MI0016051 (SEQ ID NO: 1713)
GAUUCGAUGGGCCAUAGCAAUCCUGUGAUUUAUGCAUGGAGGCUGCUUCUCCUCAGCAGCUGCCAUAGCCCGGUCGC
UGGUACAUGAUUC >hsa-mir-3652 MI0016052 (SEQ ID NO: 1714)
CGGCUGGAGGUGUGAGGAUCCGAACCCAGGGGUGGGGGGUGGAGGCGGCUCCUGCGAUCGAAGGGGACUUGAGACUC
ACCGGCCGCACGCCAUGAGGGCCCUGUGGGUGCUGGGCCUCUGCUGCGUCCUGC >hsa-mir-3653 MI0016053 (SEQ ID NO: 1715)
UCCCUGGGGACCCCUGGCAGCCCCUCCUGAUGAUUCUUCUUCCUGAGCACGCUCAUGAUGAGCAAACUGAGCCUCUA
AGAAGUUGACUGAAGGGGCUGCUUCCCCAAGGA >hsa-mir-3654 MI0016054 (SEQ ID NO: 1716)
UUCAUGAGCUGCAAUCUCAUCACUGGAAUGUUCCAGCGACUGGACAAGCUGAGGAA >hsa-mir-3655 MI0016055 (SEQ ID NO: 1717)
GCUUGUCGCUGCGGUGUUGCUGUUGGAGACUCGAUUGUUGGUGACAGCGAAAGAACGAUAACAAAAUGCCGGAGCGA
GAUAGU >hsa-mir-3656 MI0016056 (SEQ ID NO: 1718)
CUUUCGGCCAGCGGGACGGCAUCCGAGGUGGGCUAGGCUCGGGCCCGUGGCGGGUGCGGGGUGGGAGG >hsa-mir-3657 MI0016057 (SEQ ID NO: 1719)
UGUGUCCCAUAAUUAAAUAAUGAAAUCUGAAAUCACCAAUAAUGGGACACUAAUGUGAUUAAUGUUGUUGUGUCCCA
UUAUUGGUGAUUUCAGAUUUCAUAUAUGAUUAAGGACAUA >hsa-mir-3658 MI0016058 (SEQ ID NO: 1720)
UAUUUAAGAAAACACCAUGGAGAUGAAAUGCCUUUGAUUUUUUUUUCUUUUUGUA >hsa-mir-3659 MI0016060 (SEQ ID NO: 1721)
UCUACAAGCAGAUACAAGGAUGCCCUUGUACACAACACACGUGCUGCUUGUAUAGACAUGAGUGUUGUCUACGAGGG
CAUCCUUGUGUCUGUGUGUGUG >hsa-mir-3660 MI0016061 (SEQ ID NO: 1722)
GAAAGAAGAACUGGACAAAAUUAAAAUGCUCUUCUGUCAUUGUAAUAGUUCAUAUGGGCACUGACAGGAGAGCAUUU
UGACUUUGUCAAGUGUGUCUGCU >hsa-mir-3661 MI0016062 (SEQ ID NO: 1723)
CACCUUCUCGCAGAGGCUCUUGACCUGGGACUCGGACAGCUGCUUGCACUCGUUCAGCUGCUCGAUCCACUGGUCCA
GCUCCUUGGUGAACACCUU >hsa-mir-3662 MI0016063 (SEQ ID NO: 1724)
UGUGUUUUCCUCAACGCUCACAGUUACACUUCUUACUCUCAAUCCAUUCAUAUUGAAAAUGAUGAGUAGUGACUGAU
GAAGCACAAAUCAGCCAA >hsa-mir-3663 MI0016064 (SEQ ID NO: 1725)
CCCGGGACCUUGGUCCAGGCGCUGGUCUGCGUGGUGCUCGGGUGGAUAAGUCUGAUCUGAGCACCACACAGGCCGGG
CGCCGGGACCAAGGGGGCUC >hsa-mir-3664 MI0016065 (SEQ ID NO: 1726)
CUGUAAACUUGAAGGUAGGGAACUCUGUCUUCACUCAUGAGUACCUUCCAACACGAGCUCUCAGGAGUAAAGACAGA
GUUCCCUACCUUCAAUGUGGAU >hsa-mir-3665 MI0016066 (SEQ ID NO: 1727)
GCGGGCGGCGGCGGCAGCAGCAGCAGGUGCGGGGCGGCGGCCGCGCUGGCCGCUCGACUCCGCAGCUGCUCGUU
CUGCUUCUCCAGCUUGCGCACCAGCUCC >hsa-mir-3666 MI0016067 (SEQ ID NO: 1728)
AGUAAGGUCCGUCAGUUGUAAUGAGACCCAGUGCAAGUGUAGAUGCCGACUCCGUGGCAGAGUUCAGCGUUUCACAC
UGCCUGGUCUCUGUCACUCUAUUGAAUUAGAUUG >hsa-mir-3667 MI0016068 (SEQ ID NO: 1729)
UGAGGAUGAAAGACCCAUUGAGGAGAAGGUUCUGCUGGCUGAGAACCUUCCCUCUCCAUGGGUCUUUCAUCCUCA >hsa-mir-3668 MI0016069 (SEQ ID NO: 1730)
AUAUAUGAAAUGUAGAGAUUGAUCAAAAUAGUUUCUAUCAAAAUAGUUUUGAUCAAUCUCUGCAAUUUUAUAUAU >hsa-mir-3669 MI0016070 (SEQ ID NO: 1731)
AUAUAUAUAUACGGAAUAUAUAUACGGAAUAUAUAUAUACGGAAUAUAUAUAUACGGAAUAUGUAUACGGAAUAUAU
AUAU >hsa-mir-3670-1 MI0016071 (SEQ ID NO: 1732)
UCUAGACUGGUAUAGCUGCUUUUGGAGCCUCACCUGCUGAGAGCUCACAGCUGUCCUUCUCUAGA >hsa-mir-3670-2 MI0019112 (SEQ ID NO: 1733)
UCUAGACUGGUAUAGCUGCUUUUGGAGCCUCACCUGCUGAGAGCUCACAGCUGUCCUUCUCUAGA >hsa-mir-3671 MI0016072 (SEQ ID NO: 1734)
AUGUUAUUGCUGCUGUCACAUUUACAUGAAAAUAAAAUGUAAAUUAUUUUAUUUCUAUCAAAUAAGGACUAGUC
UGCAGUGAUAU >hsa-mir-3672 MI0016073 (SEQ ID NO: 1735)
UCUUUGUGAUUACCAUGAGACUCAUGUAAAACAUCUUAGACUAUUACAAGAUGUUUUAUGAGUCUCAUGAUAAUCAC
AAAGA >hsa-mir-3673 MI0016074 (SEQ ID NO: 1736)
AUAUAUAUAUAUGGAAUGUAUAUACGGAAUAUAUAUAUAUGGAAUGUAUAUACGGAAUAUAUAUAUAUGGAAU
GUAUAUACGGAAUAUAUAUAUAUAU >hsa-mir-3674 MI0016075 (SEQ ID NO: 1737)
ACAUCACUAUUGUAGAACCUAAGAUUGGCCGUUUGAGAUGUCCUUUCAAGUUUUUGCAUUUCUGAUGU >hsa-mir-3675 MI0016076 (SEQ ID NO: 1738)
GGAUGAUAAGUUAUGGGGCUUCUGUAGAGAUUUCUAUGAGAACAUCUCUAAGGAACUCCCCCAAACUGAAUUC >hsa-mir-3676 MI0016077 (SEQ ID NO: 1739)
UUGGUUAAAGCGCCUGUCUAGUAAACAGGAGAUCCUGGGUUCGAAUCCCAGCGGUGCCUCCGUGUUUCCCCACGCU
UUUGCCAA >hsa-mir-3677 MI0016078 (SEQ ID NO: 1740)
GGCAGUGGCCAGAGCCCUGCAGUGCUGGGCAUGGGCUUCUCGUGGGCUCUGGCCACGGCC >hsa-mir-3678 MI0016079 (SEQ ID NO: 1741)
GAAUCCGGUCCGUACAAACUCUGCUGUGUUGAAUGAUUGGUGAGUUUGUUUGCUCAUUGAUUGAAUCACUGCAGAGU
UUGUACGGACCGGAUUC >hsa-mir-3679 MI0016080 (SEQ ID NO: 1742)
CGUGGUGAGGAUAUGGCAGGGAAGGGGAGUUUCCCUCUAUUCCCUUCCCCCAGUAAUCUUCAUCAUG >hsa-mir-3680-1 MI0016081 (SEQ ID NO: 1743)
AAAUUUAAGGAGGGACUCACUCACAGGAUUGUGCAAAUGCAAAGUUGGCUUUUGCAUGACCCUGGGAGUAGGUGCCU
CCUUAAAUUU >hsa-mir-3680-2 MI0019113 (SEQ ID NO: 1744)
AAAUUUAAGGAGGGACUCACUCACAGGAUUGUGCAAAUGCAAAGUUGGCUUUUGCAUGACCCUGGGAGUAGGUGCCU
CCUUAAAUUU >hsa-mir-3681 MI0016082 (SEQ ID NO: 1745)
ACUUCCAGUAGUGGAUGAUGCACUCUGUGCAGGGCCAACUGUGCACACAGUGCUUCAUCCACUACUGGAAGU >hsa-mir-3682 MI0016083 (SEQ ID NO: 1746)
UAAGUUAUAUAUGUCUACUUCUACCUGUGUUAUCAUAAUAAAGGUGUCAUGAUGAUACAGGUGGAGGUAGAAAUAUA
UAACUUA >hsa-mir-3683 MI0016084 (SEQ ID NO: 1747)
GGGUGUACACCCCUGCGACAUUGGAAGUAGUAUCAUCUCUCCCUUGGAUGCUACGAACAAUAUCACAGAAGGUGUA
CACCC >hsa-mir-3684 MI0016085 (SEQ ID NO: 1748)
AAUCUAAAGGACCUGUACUAGGUUUAACAUGUUGAGCAUUACUCAUGUUAGACCUAGUACACGUCCUUUAGAUU >hsa-mir-3685 MI0016086 (SEQ ID NO: 1749)
GUACAUUUCCUACCCUACCUGAAGACUUGAGAUUAUAGUCUUUGGGGGGAUGGGCAAAGUAC >hsa-mir-3686 MI0016087 (SEQ ID NO: 1750)
CUCACCUCAUUCAUUUACCUUCUCUUACAGAUCACUUUUCUGCACUGGACAGUGAUCUGUAAGAGAAAGUAAAUGAA
AGAGGUGAG >hsa-mir-3687 MI0016088 (SEQ ID NO: 1751)
CGCGCGUGCGCCCGAGCGCGGCCCGGUGGUCCCUCCCGGACAGGCGUUCGUGCGACGUGUG >hsa-mir-3688-1 MI0016089 (SEQ ID NO: 1752)
UCUUCACUUUCAAGAGUGGCAAAGUCUUUCCAUAUGUAUGUAUGUAUGUCUGUUACACAUAUGGAAAGACUUUGCCA
CUCUUUAAAGUGAAGA >hsa-mir-3688-2 MI0017447 (SEQ ID NO: 1753)
UCACUUUAAAGAGUGGCAAAGUCUUUCCAUAUGUGUAACAGACAUACAUACAUAUGGAAAGACUUUGCCACUC
UUGAAAGUGA >hsa-mir-3689a MI0016090 (SEQ ID NO: 1754)
CCUGGGAGGUGUGAUAUCAUGGUUCCUGGGAGGUGUGAUCCUGUGCUUCCUGGGAGGUGUGAUAUCGUGGUUCCUGGG >hsa-mir-3689b MI0016411 (SEQ ID NO: 1755)
GAUCCUGUGCUCCCUGGGGGGUCUGAUCCUGUGCUUCCUGGGAGGUGUGAUAUCAUGGUUCCUGGGAGGUGUGAUCC
CGUGCUUCCUGGGAGGUGUGAUAUUGUGGUUCCUGGGAGGUGUGAUCCCGUGCUCCCUGGGAGGUGUGAUC >hsa-mir-3689c MI0016832 (SEQ ID NO: 1756)
GGGAGGUGUGAUAUCGUGGUUCCUGGGAGGUGUGAUAUCGUGGUUCCUGGGAGGUGUGAUAUUGUGGUUCCU >hsa-mir-3689d-1 MI0016834 (SEQ ID NO: 1757)
UGGGAGGUGUGAUCUCACACUCGCUGGGAGGUGUGCUAUCGUCUUCCCCGGGAGGUGUGAUCCUGUUCUUCCUG >hsa-mir-3689d-2 MI0016835 (SEQ ID NO: 1758)
ACUGGGAGGUGUGAUCUCACACUCGCUGGGAGGUGUGCUAUCGUCUUCCCUGGGAGGUGUGAUCCUGUUCUUCCUGA
GCG >hsa-mir-3689e MI0016836 (SEQ ID NO: 1759)
GGGAGGUGUGAUAUCAUGGUUCCUGGGAGGUAUGAUAUCGUGGUUCCUGGGAGGUGUGAUCCCGUGCUCCCU >hsa-mir-3689f MI0016837 (SEQ ID NO: 1760)
AGGUGUGAUAUCGUGCUUCCUGGGACGUGUGAUGCUGUGCUUCCUGGGAGGUGUGAUCCCACACUC >hsa-mir-3690 MI0016091 (SEQ ID NO: 1761)
CCCAUCUCCACCUGGACCCAGCGUAGACAAAGAGGUGUUUCUACUCCAUAUCUACCUGGACCCAGUGUAGAUGGG >hsa-mir-3691 MI0016092 (SEQ ID NO: 1762)
UUGAGGCACUGGGUAGUGGAUGAUGGAGACUCGGUACCCACUGCUGAGGGUGGGGACCAAGUCUGCGUCAUCCUCUC
CUCAGUGCCUCAA >hsa-mir-3692 MI0016093 (SEQ ID NO: 1763)
CCAUUCCUGCUGGUCAGGAGUGGAUACUGGAGCAAUAGAUACAGUUCCACACUGACACUGCAGAAGUGG >hsa-mir-3713 MI0016134 (SEQ ID NO: 1764)
GGUAUCCGUUUGGGGAUGGUUUCACUAUCCCCAGAUGGAUACCAA >hsa-mir-3714 MI0016135 (SEQ ID NO: 1765)
GAAGGCAGCAGUGCUCCCCUGUGACGUGCUCCAUCACCGGGCAGGGAAGACACCGCUGCCACCUC >hsa-mir-3907 MI0016410 (SEQ ID NO: 1766)
GGGUUGGAAAGCUGUAGGUGUGGAGGGGCAUGGAUACGGGGGCCAUGAGGGUGGGGUCCAGGCUGGACCAGGCCUGC
CCUGAGUCCCCAGCAGGUGCUCCAGGCUGGCUCACACCCUCUGCCUCUCUCUCUUCCUUCCUGGCCCCAACCC >hsa-mir-3908 MI0016412 (SEQ ID NO: 1767)
GCCUGAGCAAUGUAGGUAGACUGUUUCUAAAAAAAUAAAAAGUUAAAAAAAUUUAUGUUAACGUGUAAUGUGUUUAC
UAAUUUUUUUUUUUUUUUUGGAGACAGAGUCUCCCUCUGUCGCCAGGC >hsa-mir-3909 MI0016413 (SEQ ID NO: 1768)
GGUAUGCUGUUGCGCUGUCCUUCCUCUGGGGAGCAGGCUCCGGGGGACAGGGAAAAGCACACAAGGAACUUGUCCUC
UAGGGCCUGCAGUCUCAUGGGAGAGUGACAUGCACCAGGACC >hsa-mir-3910-1 MI0016414 (SEQ ID NO: 1769)
CUUUUGCUGUCAGUUUUUCUGUUGCUUGUCUUGGUUUUAUGCCUUUUAUAUCAAGGCACAUAAAAGGCAUAAAACCA
AGACAAGCAACAAAAAAAGGAUUGAUCACAGAAG >hsa-mir-3910-2 MI0016431 (SEQ ID NO: 1770)
UUUUUUUGUUGCUUGUCUUGGUUUUAUGCCUUUUAUGUGCCUUGAUAUAAAAGGCAUAAAACCAAGACAAGCAACAG
AAAAA >hsa-mir-3911 MI0016415 (SEQ ID NO: 1771)
GGGUGAGGAUGUGUGGAUCCUGGAGGAGGCAGAGAAGACAGUGAGCUUGCCAGUUCUGGUUUCCAACACUUCCUU
UCCUGCGCUUCUCGAUUCCCAGAUCUGCACCC >hsa-mir-3912 MI0016416 (SEQ ID NO: 1772)
AGAGAGGAAUGAACAGUUAAAUUAUAACAUGUCCAUAUUAUGGGUUAGUUGUGGACACAUACUAACGCAUAAUAUGG
ACAUGUUAUAAUUUAACUGUUCCUUUCU >hsa-mir-3913-1 MI0016417 (SEQ ID NO: 1773)
UUGUUUAUAAUAAACUGAAAUAUUUGGGACUGAUCUUGAUGUCUGCCAAAACCUUGGCAGACAUCAAGAUCAGUCCC
AAAUAUUUCAGUUUAUUAUAGACAG >hsa-mir-3913-2 MI0016418 (SEQ ID NO: 1774)
UGUCUAUAAUAAACUGAAAUAUUUGGGACUGAUCUUGAUGUCUGCCAAGGUUUUGGCAGACAUCAAGAUCAGUCCCA
AAUAUUUCAGUUUAUUAUAAACA -continued >hsa-mir-3914-1 MI0016419 (SEQ ID NO: 1775)
UGGACUUCAGAUUUAACUUCUCAUUUUCUGGUUCCUUCUAAUGAGUAUGCUUAACUUGGUAGAAGGAACCAGAAAAU
GAGAAGUUGAGUAGGAACUCUA >hsa-mir-3914-2 MI0016421 (SEQ ID NO: 1776)
GAGUUCCUACUCAACUUCUCAUUUUCUGGUUCCUUCUACCAAGUUAAGCAUACUCAUUAGAAGGAACCAGAAAAUGA
GAAGUUAAAUCUGAAGUC >hsa-mir-3915 MI0016420 (SEQ ID NO: 1777)
CAAGUUGGCACUGUAGAAUAUUGAGGAAAAGAUGGUCUUAUUGCAAAGAUUUUCAAUAAGACCAUCCUUUCCUCAAU
AUUCUGUGGUGUCAUCUUUG >hsa-mir-3916 MI0016422 (SEQ ID NO: 1778)
AUCCCAGAGAAGAAGGAAGAAGAGGAAGAAAUGGCUGGUUCUCAGGUGAAUGUGUCUGGGUUCAGGGGAUGUGUCUC
CUCUUUUCUUCUGGGAU >hsa-mir-3917 MI0016423 (SEQ ID NO: 1779)
GGCGCUUUUGUGCGCGCCCGGGUCUGUUGGUGCUCAGAGUGUGGUCAGGCGGCUCGGACUGAGCAGGUGGGUGCGGG
GCUCGGAGGAGGCGGC >hsa-mir-3918 MI0016424 (SEQ ID NO: 1780)
AGGCGGUUAAGCCAUGGGACAGGGCCGCAGAUGGAGACUGCUCAAGGUCAAAGGGGUCUCCAGCUGGGACCCUGCAC
CUGGUUCGUAGCCCCU >hsa-mir-3919 MI0016425 (SEQ ID NO: 1781)
CCUGAGCACCAUUUACUGAGUCCUUUGUUCUCUACUAGUUUGUAGUAGUUCGUAGCAGAGAACAAAGGACUCAGUAA
AUGGUGCUCAGG >hsa-mir-3920 MI0016427 (SEQ ID NO: 1782)
ACUGAGUGAGGGAGUCAGAGAGUUAAGAGAAUUAGUACAGGUGAGAUUGUACUGAUUAUCUUAACUCUCUGACCCCC
UCACUCAGU >hsa-mir-3921 MI0016428 (SEQ ID NO: 1783)
CCUAGCCCAGUACAAGGCAUAUGGUACUCAAGAGACUUAGAAAUCCCUAAGUCUCUGAGUACCAUAUGCCUUGUACU
GGGCUAGG >hsa-mir-3922 MI0016429 (SEQ ID NO: 1784)
GGAAGAGUCAAGUCAAGGCCAGAGGUCCCACAGCAGGGCUGGAAAGCACACCUGUGGGACUUCUGGCCUUGACUUGA
CUCUUUC >hsa-mir-3923 MI0016430 (SEQ ID NO: 1785)
GGUAGAGUGAGCUCUAAUCCAAUAUUACUAGCUUCUUUAUAAGAAGAGGAAACUAGUAAUGUUGGAUUAGGGCUCAC
UCUACU >hsa-mir-3924 MI0016432 (SEQ ID NO: 1786)
UAAAUGAAAAGUAGUAGUCAAAUAUGCAGAUCUAUGUCAUAUAUACAGAUAUGUAUAUGUGACUGCUACUUUUUUG
UUUA >hsa-mir-3925 MI0016433 (SEQ ID NO: 1787)
GUGGGAAUAGCAAGAGAACUGAAAGUGGAGCCUGUCACAUCCCAGACUCCAGUUUUAGUUCUCUUGCUAUUUCCAC >hsa-mir-3926-1 MI0016434 (SEQ ID NO: 1788)
AAAAUGGAGCUGGCCAAAAAGCAGGCAGAGACUUUAAAAGCGUCUCUGCCUGCUUUUUGGCCAGCUCCGUUUU >hsa-mir-3926-2 MI0016437 (SEQ ID NO: 1789)
GGAGCUGGCCAAAAAGCAGGCAGAGACGCUUUUAAAGUCUCUGCCUGCUUUUUGGCCAGCUCC >hsa-mir-3927 MI0016435 (SEQ ID NO: 1790)
UGCCAAUGCCUAUCACAUAUCUGCCUGUCCUAUGACAAACAUGGCAGGUAGAUAUUUGAUAGGCAUUGGCA >hsa-mir-3928 MI0016438 (SEQ ID NO: 1791)
GCUGAAGCUCUAAGGUUCCGCCUGCGGGCAGGAAGCGGAGGAACCUUGGAGCUUCGGC >hsa-mir-3929 MI0016439 (SEQ ID NO: 1792)
AGUGGCUCACACCAGUAAUCCCAGCACUUUGGGAGGCUGAUGUGAGUAGACCACU >hsa-mir-3934 MI0016590 (SEQ ID NO: 1793)
CACAGCCCUUCCUGUCCCCAGUUUUCAGGUGUGGAAACUGAGGCAGGAGGCAGUGAAGUAACUUGCUCAGGUUGCAC
AGCUGGGAAGUGGAGCAGGGAUUUGAAUCC >hsa-mir-3935 MI0016591 (SEQ ID NO: 1794)
GGAUGUGUUCCUGUCCCAGAAGGAGCUGAUGGUUGUAUCUAUGAAGGUAAGCAUUUUUGUAGAUACGAGCACCAGCC
ACCCUAAGCAAAGGCAGAGAAUGCUUA >hsa-mir-3936 MI0016592 (SEQ ID NO: 1795)
AUGAUUCAGAGCAUCUGUCCAGUGUCUGCUGUAGAUCCCUCAAAUCCGUGUUUGGACGCUUCUGGUAAGGGGUGUAU
GGCAGAUGCACCCGACAGAUGCACUUGGCAGCA -continued >hsa-mir-3937 MI0016593 (SEQ ID NO: 1796)
AGAAGAAUGCCCAACCAGCCCUCAGUUGCUACAGUUCCCUGUUGUUUCAGCUCGACAACAACAGGCGGCUGUAGCAA
UGGGGGGCUGGAUGGGCAUCUCAAUGUGC >hsa-mir-3938 MI0016594 (SEQ ID NO: 1797)
AGGAAUUUUUAACCCGAUCACUAGAUUAUCUACAAGGGAAUUUUUUUUUAAUUUAAAAAAAUUCCCUUGUAGAUAACC
CGGUGGUCAGGUUGGAUGGCUCCAUG >hsa-mir-3939 MI0016596 (SEQ ID NO: 1798)
CUGGCUUCCAAAGGCCUCUGUGUGUUCCUGUAUGUGGGCGUGCACGUACCUGUCACAUGUGUACGCGCAGACCACAG
GAUGUCCACACUGGCUUCCAAACACAUCU >hsa-mir-3940 MI0016597 (SEQ ID NO: 1799)
GCUUAUCGAGGAAAAGAUCGAGGUGGGUUGGGGCGGGCUCUGGGGAUUUGGUCUCACAGCCCGGAUCCCAGCCCACU
UACCUUGGUUACUCUCCUUCCUUCU >hsa-mir-3941 MI0016598 (SEQ ID NO: 1800)
GAGUCAGAAUUCUCAUCAGGCUGUGAUGCUCAGUUGUGUGUAGAUUGAAAGCCCUAAUUUUACACACAACUGAGGAU
CAUAGCCUGAUGGUUCCUUUUUGUUU >hsa-mir-3942 MI0016599 (SEQ ID NO: 1801)
UCUUCAGUAUGACACCUCAAAGAAGCAAUACUGUUACCUGAAAUAGGCUGCGAAGAUAACAGUAUUUCAGAUAACAG
UAUUACAUCUUUGAAGUGUCAUAUUCACUGAC >hsa-mir-3943 MI0016600 (SEQ ID NO: 1802)
CACACAGACGGCAGCUGCGGCCUAGCCCCCAGGCUUCACUUGGCGUGGACAACUUGCUAAGUAAAGUGGGGGUGGG
CCACGGCUGGCUCCUACCUGGAC >hsa-mir-3944 MI0016601 (SEQ ID NO: 1803)
UCCACCCAGCAGGCGCAGGUCCUGUGCAGCAGGCCAACCGAGAAGCGCCUGCGUCUCCCAUUUUCGGGCUGGCCUGC
UGCUCCGGACCUGUGCCUGAUCUUAAUGCUG >hsa-mir-3945 MI0016602 (SEQ ID NO: 1804)
GAUGUUGAUGCACGUGACGGGGAGGGCAUAGGAGAGGGUUGAUAUAAAAUGCAAUUACAGCCUCUUAUGCUUUCCAA
AGUGGGGGAUGAUUCAAUGAU >hsa-mir-3960 MI0016964 (SEQ ID NO: 1805)
GGCGCCCCGGCUCCCCGCGCCCCCGAUCGGGGCCGCCGCUAGUAGUGGCGGCGGCGGAGGCGGGGGCAGCGGCGGCG
GCGGCGGAGGCGCC >hsa-mir-3972 MI0016990 (SEQ ID NO: 1806)
GCCCAUUUGCCUUGGCUUGGGGUGGCAGUCCUGUGGGAAUGAGAGAUGCCAAACUGGACCUGCCAGCCCCGUUCCAG
GGCACAGCAU >hsa-mir-3973 MI0016991 (SEQ ID NO: 1807)
GCCCAGGGUAGCUCUCUGUAUUGCUUGUUACAUUUUAGGAUUGCUUGCCCCUUGCUCCAAUGGUGCAGGCAGAAGAA
AUGCAAACAAAGUACAGCAUUAGCCUUAGC >hsa-mir-3974 MI0016992 (SEQ ID NO: 1808)
GUUCAGGGAAAAGGUCAUUGUAAGGUUAAUGCACCCAUAUUUUAAUAUCAAACUAUGACAAAUUUGACUACAGCCUU
UCCGUACCCCUGCCAAAAC >hsa-mir-3975 MI0016993 (SEQ ID NO: 1809)
CAUGUAGGUGAGUGAUUGCUAUUUCAAAAGACUAGAGGUAGGAAAUGAGGCUAAUGCACUACUUCACAUG >hsa-mir-3976 MI0016994 (SEQ ID NO: 1810)
UGAGGGAUAUAGAGAGCAGGAAGAUUAAUGUCAUAUUGGAGUUGGACUGCAGGGCUUCCUUUACACAAUAAAUAUUG
UAUGAAGUGCUGAUGUAACCUUUACUGCAGCAUGACAUGGGAUUUGGCUGUUUUUAUGGCUC >hsa-mir-3977 MI0016995 (SEQ ID NO: 1811)
UUGUGCUUCAUCGUAAUUAACCUUAAGUGGUUCGGGUAAAUCACUUUAAUUUGUUAUGUGUUGGCAGAAU >hsa-mir-3978 MI0016996 (SEQ ID NO: 1812)
UCAGUGGAAAGCAUGCAUCCAGGGUGUGGAGCCAAAAUUAGAAGGGCCAAAAUUCUACCUGGCCCACUACCACAGCA
ACCUUGGGCAUCGUUUUCUUUUGA >hsa-mir-4251 MI0015861 (SEQ ID NO: 1813)
CACGUCCUCCAGCUUUUUUCCUUAGUGGCCAAUUCCUGAGAAAAGGGCCAACGUGCUUCCA >hsa-mir-4252 MI0015864 (SEQ ID NO: 1814)
UGGGGGGCUGGCAGCUCAUCAGUCCAGGCCAUCUGGCCACUGAGUCAGCACCAGCGCCCAAUC >hsa-mir-4253 MI0015860 (SEQ ID NO: 1815)
CCAGCCAUCGCCCUUGAGGGGCCCUAGGACUUACUUGUGCAGGGCAUGUCCAGGGGGUCCAGGUCUGC >hsa-mir-4254 MI0015862 (SEQ ID NO: 1816)
CUUGGGAGGAGGGUGGGGUGGCUCCUCUGCAGUGAGUAGGUCUGCCUGGAGCUACUCCACCAUCUCCCCCAGCCCC >hsa-mir-4255 MI0015863 (SEQ ID NO: 1817)
GAGCAUCCUUCAGUGUUCAGAGAUGGAGUCAGUAUUGGUCUGGCCAUUUUUAGGGCAAAGAGGCAGCAUCAU >hsa-mir-4256 MI0015855 (SEQ ID NO: 1818)
UGUUCCAUUUAUCUGACCUGAUGAAGGUCUCCUGGCAUUGAUUAGGUCUGAUGAUCCAUUUCUG >hsa-mir-4257 MI0015856 (SEQ ID NO: 1819)
GGCUUAGAAACAGUCCCUAGGUAGGAUUUGGGGAGGAGCUAAGAAGCCCCUACAGGGCCCAGAGGUGGGGACUGAGC
CUUAGUUGG >hsa-mir-4258 MI0015857 (SEQ ID NO: 1820)
ACGCCCCCGCCCCGCCACCGCCUUGGAGGCUGACCUCUUACUUUCGGUCGGUCUUCUUCCCUGGGCUUGGUUUGGG
GGCGGGGGAGUGUC >hsa-mir-4259 MI0015858 (SEQ ID NO: 1821)
GAUGGGCCCCUUGUGUCCUGAAUUGGUGGGGCUCUGAGUGGGGAAAGUGGGGGCCUAGGGGAGGUCACAGUUGGG
UCUAGGGGUCAGGAGGGCCCAGGA >hsa-mir-4260 MI0015859 (SEQ ID NO: 1822)
AACAAGGUGACUUGGGGCAUGGAGUCCCACUUCCUGGAGCCCACACCCCAGCUUGUCACACACCAAC >hsa-mir-4261 MI0015868 (SEQ ID NO: 1823)
GGUGGAAGUGGGUUCCUCCCAGUUCCUGAGACAGGAAACAGGGACCCAGGAGACCAGC >hsa-mir-4262 MI0015872 (SEQ ID NO: 1824)
GAAAGCUGCAGGUGCUGAUGUUGGGGGGACAUUCAGACUACCUGCAGCAGAGCC >hsa-mir-4263 MI0015876 (SEQ ID NO: 1825)
AUAGUGCUCUUCAGGGUUUUACUUGGGAGAUUGGAGUGGCCAGUGUUCCUAAACAAUUCUAAGUGCCUUGGCCCACA
ACAUAC >hsa-mir-4264 MI0015877 (SEQ ID NO: 1826)
AAAGCUGGAUACUCAGUCAUGGUCAUUGUAACAUGAUAGUGACAGGUACUGGGUAAGACUGCAUAG >hsa-mir-4265 MI0015869 (SEQ ID NO: 1827)
UGCAGUGGGUUGGAGCUUCAGCCUACACCUGUAAAGAAUUGGUCAGCCUGGGGACUGGUGAUCUCUGCAGCUGUGGG
CUCAGCUCUGGGCUGGGCCUGG >hsa-mir-4266 MI0015870 (SEQ ID NO: 1828)
CCACUGCUGGCCGGGGCCCCUACUCAAGGCUAGGAGGCCUUGGCCAAGGACAGUC >hsa-mir-4267 MI0015871 (SEQ ID NO: 1829)
CUCAGCAGGCUCCAGCUCGGUGGCACUGGGGGAAGGCUCCAGACCCCAGCCUCUGUCAUCCCUGCAUGGAGCCCACA
UCUCC >hsa-mir-4268 MI0015874 (SEQ ID NO: 1830)
AUGCACAUCAGGUUCUAGAGGUUUUGCCCUAGCGGCUCCUCCUCUCAGGAUGUGAUGUCACCUG >hsa-mir-4269 MI0015875 (SEQ ID NO: 1831)
ACAGCGCCCUGCAGGCACAGACAGCCCUGGCUUCUGCCUCUUUCUUUGUGGAAGCCACUCUGUCAGGCCUGGGAUGG
AGGGGCA >hsa-mir-4270 MI0015878 (SEQ ID NO: 1832)
ACAAAUAGCUUCAGGGAGUCAGGGGAGGGCAGAAAUAGAUGGCCUUCCCCUGCUGGGAAGAAAGUGGGUC >hsa-mir-4271 MI0015879 (SEQ ID NO: 1833)
AAAUCUCUCUCCAUAUCUUUCCUGCAGCCCCCAGGUGGGGGGAAGAAAAGGUGGGGAAUUAGAUUC >hsa-mir-4272 MI0015880 (SEQ ID NO: 1834)
UUUUCUGCACAAAUUAAUCAGUUAAUGCAUAGAAAGCAUUCAACUAGUGAUUGUGUUAUAAGAG >hsa-mir-4273 MI0015881 (SEQ ID NO: 1835)
UCCCCUGUGUGUGUUCUCUGAUGGACAGUAAGCCUUGACUUAUGGCUAAAUGCUUCUUCACAAUGGUCACAUGCAUA
GGGCUUU >hsa-mir-4274 MI0015884 (SEQ ID NO: 1836)
GGGGCAUUUAGGGUAACUGAGCUGCUGCCGGGGCCUGGCGCUCCUCUACCUUGUCAGGUGACCCAGCAGUCCCUCCC
CCUGCAUGGUGCCC >hsa-mir-4275 MI0015883 (SEQ ID NO: 1837)
ACAUUUUUGUCCAAUUACCACUUCUUUUUGCCACCUGAGCACAGUCAGCAGUCAGCAUAAAAAAGUGAUAAUGGGAA
GUUAAUGUCU >hsa-mir-4276 MI0015882 (SEQ ID NO: 1838)
CACAGUCUGACUCAGUGACUCAUGUGCUGGCAGUGGCCACGUAAAUAGAGCUACUGUGUCUGAAAGCAAU >hsa-mir-4277 MI0015886 (SEQ ID NO: 1839)
CUGGGUCGAGGCAGUUCUGAGCACAGUACACUGGGCUGCCCCCACUGCCCAGUGCCCUGCUCAGCUCAAGUCCUUGU
GCCCCUC >hsa-mir-4278 MI0015888 (SEQ ID NO: 1840)
AUCUAACACCAGGAGAAUCCCAUAGAACAUUGACAUCAACACUAGGGGGUUUGCCCUUGUGGGGAAGAA >hsa-mir-4279 MI0015887 (SEQ ID NO: 1841)
UGCUCUGUGGAGCUGAGGAGCAGAUUCUCUCUCUCUCCUCCCGGCUUCACCUCCUGAG >hsa-mir-4280 MI0015889 (SEQ ID NO: 1842)
AAUCAGGGUGGAGUGUAGUUCUGAGCAGAGCCUUAAAGGAUGAGGUAUGUUCAAGACUGAAUGACACCUUUGUGAU >hsa-mir-4281 MI0015885 (SEQ ID NO: 1843)
GCUGGGGGUCCCCCGACAGUGUGGAGCUGGGGCCGGGUCCCGGGGAGGGGGGUUCUGGGCAG >hsa-mir-4282 MI0015890 (SEQ ID NO: 1844)
GGUGAAGUUCCAGGGGAAGAUUUUAGUAUGCCACAUUUCUAAAAUUUGCAUCCAGGAACAUCAUCCU >hsa-mir-4283-1 MI0015892 (SEQ ID NO: 1845)
ACUCUGAUCCUGGGGCUCAGCGAGUUUGCAAGGGGUGUUUCUGUCCAUGGUCAGGCUUGCCAGCCUUGGUCCUUGGG
CCC >hsa-mir-4283-2 MI0015982 (SEQ ID NO: 1846)
ACUCUGAUCCUGGGGCUCAGCGAGUUUGCAAGGGGUGUUUCUGUCCAUGGUCAGGCUUGCCAGCCUUGGUCCUUGGG
CCC >hsa-mir-4284 MI0015893 (SEQ ID NO: 1847)
GUUCUGUGAGGGGCUCACAUCACCCCAUCAAAGUGGGGACUCAUGGGGAGAGGGGUAGUUAGGAGCUUUGAUAGAG
GCGG >hsa-mir-4285 MI0015891 (SEQ ID NO: 1848)
AUUAGCUGGGGCGGCGAGUCCGACUCAUCAAUAUUUUAAGGAAUGACCCGGCCUUGGGGUGCGGAAUUGCUGCGCGG
GCGGGGGC >hsa-mir-4286 MI0015894 (SEQ ID NO: 1849)
UACUUAUGGCACCCCACUCCUGGUACCAUAGUCAUAAGUUAGGAGAUGUUAGAGCUGUGAGUACCAUGACUUAAGUG
UGGUGGCUUAAACAUG >hsa-mir-4287 MI0015895 (SEQ ID NO: 1850)
UAGUUCUUUUCUCCCUUGAGGGCACUUUUCAGUUCCUGAGAUCAAUGUGGUCCCUACUGGGGAGACCAUAGGAGCCC >hsa-mir-4288 MI0015896 (SEQ ID NO: 1851)
AUGGAGGUGGAGAGUCAUCAGCAGCACUGAGCAGGCAGUGUUGUCUGCUGAGUUUCCACGUCAUUUG >hsa-mir-4289 MI0015898 (SEQ ID NO: 1852)
CCUUGGGAGGGCAUUGUGCAGGGCUAUCAGGCAGUUUCCUGGGCCCUGUCUGCAGAGCCUAAACAGAUCA >hsa-mir-4290 MI0015899 (SEQ ID NO: 1853)
GCCACCAAGAAGGUGAAGGGAGGGUCAGUCCCAAUCUGAAUCCCACCAAAAUAGGUGGUAGAGGGUUGCCCUCCUUU
CUUCCCUCACCUCUGACC >hsa-mir-4291 MI0015900 (SEQ ID NO: 1854)
CGCCGGGGGCUUCAGCAGGAACAGCUGGGUGGAGGCAGAGCUGUUCUGCUGUGGCUGCAGCCCUG >hsa-mir-4292 MI0015897 (SEQ ID NO: 1855)
GAGACACCAGAAGGCCACCUGCUUAGGAGGCCAGAGGUGCCCCUGGGCCGGCCUUGGUGAGGGGCCC >hsa-mir-4293 MI0015826 (SEQ ID NO: 1856)
AGAGACACCUGUUCCUUGGGAAGCUGGUGACAUUGCUAAUUCAUUUCACACCAGCCUGACAGGAACAGCCUGACUGAA >hsa-mir-4294 MI0015827 (SEQ ID NO: 1857)
CCGAUGCCUCGGGAGUCUACAGCAGGGCCAUGUCUGUGAGGGCCCAAGGGUGCAUGUGUCUCCCAGGUUUCGGUGC >hsa-mir-4295 MI0015822 (SEQ ID NO: 1858)
CUUUGUGGAACAGUGCAAUGUUUUCCUUGCCUGUGGCAAGACCACUUCGGUUCAAGGCUAAGAAACUAGACUGUUCC
UACAGAGA >hsa-mir-4296 MI0015823 (SEQ ID NO: 1859)
UUGGGCUUUGAUGUGGGCUCAGGCUCAGAGGGCUGAAGUGGUUGUGGGGAGGGGCUUCUGGGGACUGUGUCCAUGUC
UCUGUCGUUUU >hsa-mir-4297 MI0015824 (SEQ ID NO: 1860)
AGCACGCACGUGCCUUCCUGUCUGUGCCUGCCUUCGAAGUGCACGGCAGGGCCAGGACGGGUCGCUGUGGGUGGGG >hsa-mir-4298 MI0015830 (SEQ ID NO: 1861)
GGGGAGGUACCUGGGACAGGAGGAGGAGGCAGCCUUGCCUCAGAAAACCAAACUGUCAAAAGUGUAGGUUCCAC >hsa-mir-4299 MI0015829 (SEQ ID NO: 1862)
GGGUUCUGACCAAUCAUGUUACAGUGUUUUCUCCUUUAGAGAGAGCUGGUGACAUGAGAGGCAGAAAAAGGA >hsa-mir-4300 MI0015831 (SEQ ID NO: 1863)
UGAGUUUAGAAGAGGGCCAGCUAAAUCAGCAGAGACAUGAGGUGAUCAAAAACCUUUUUCAAAGCAGUGGGAGCUG
GACUACUUCUGAACCAAUA >hsa-mir-4301 MI0015828 (SEQ ID NO: 1864)
ACCAGCCACCUCCCACUACUUCACUUGUGAACAUUGCAUUCGUGGAGGGUGGCAGGUGCAGCUCUG >hsa-mir-4302 MI0015833 (SEQ ID NO: 1865)
UCAGGAGGGACCAGUGUGGCUCAGCGAGGUGGCUGAGUUUACUUAAGGUAUUGGAAUGAG >hsa-mir-4303 MI0015834 (SEQ ID NO: 1866)
AGAAAAUAGCUUCUGAGCUGAGGACAGCUUGCUCUGCUUUUCUUUAGCUUAGGAGCUAACCAUGGU >hsa-mir-4304 MI0015832 (SEQ ID NO: 1867)
AGAGAAGUGGCCGGCAUGUCCAGGGCAUCCCCAUUGCUCUGUGACUGCUGCCAUCCUUCUCC >hsa-mir-4305 MI0015835 (SEQ ID NO: 1868)
CUGCCUUAGACCUAGACACCUCCAGUUCUGGGUUCUUAGAGGCCUAAUCCUCUACAAACUCAGUUUUCAGACUGUGA
GGGAAAUUCUCUGUCUUAUUGCUUU >hsa-mir-4306 MI0015836 (SEQ ID NO: 1869)
AAGCUGCUUAGUGUCCUUAGAGUCUCCAGAGGCAUCCCUAACCCAGAAUCUUUUGACUGUCCUCUGGAGAGAAAGGC
AGUAGGUCUGUACC >hsa-mir-4307 MI0015838 (SEQ ID NO: 1870)
UCAGAAGAAAAAACAGGAGAUAAAGUUUGUGAUAAUGUUUGUCUAUAUAGUUAUGAAUGUUUUUUCCUGUUUCCUUC
AGGGCCA >hsa-mir-4308 MI0015839 (SEQ ID NO: 1871)
UAUGGGUUCAGAGGGAACUCCAUUGGACAGAAAUUUCCUUUUGAGGAAAUCUUUCCCUGGAGUUUCUUCUUACCUUU
UUCC >hsa-mir-4309 MI0015837 (SEQ ID NO: 1872)
UCUGGGGGUUCUGGAGUCUAGGAUUCCAGGAUCUGGGUUUUGAGGUCUUGGGUUGUAGGGUCUGCGGUUUGAAGCCC
CUCUUG >hsa-mir-4310 MI0015840 (SEQ ID NO: 1873)
UGGCGUCUGGGGCCUGAGGCUGCAGAACAUUGCAGCAUUCAUGUCCCACCCCCACCA >hsa-mir-4311 MI0015841 (SEQ ID NO: 1874)
UCAGAGAGGGGAAAGAGAGCUGAGUGUGACCUGGAGCAGCUCAGGAGGGCUUCCUGGGUGAGGUGGCAGGUUACAGG
UUCGAUCUUUGGCCCUCAGAUUC >hsa-mir-4312 MI0015842 (SEQ ID NO: 1875)
GAAAGGUUGGGGCACAGAGAGCAAGGAGCCUUCCCCAGAGGAGUCAGGCCUUGUUCCUGUCCCCAUUCCUCAGAG >hsa-mir-4313 MI0015843 (SEQ ID NO: 1876)
GAUCAGGCCCAGCCCCUGGCCCCAAACCCUGCAGCCCCAGCUGGAGGAUGAGGAGAUGCUGGGCUUGGGUGGGGA
AUCAGGGGUGUAAAGGGGCCUGCU >hsa-mir-4314 MI0015846 (SEQ ID NO: 1877)
GGCCAUUCCUCUCUGGGAAAUGGGACAGGUAGUGGCCACAGUGAGAAAGCUGGCCUGUCCUUCUGCCCCAGGGCCCA
GAGUCUGUGACUGGA >hsa-mir-4315-1 MI0015844 (SEQ ID NO: 1878)
UGGGCUUUGCCCGCUUUCUGAGCUGGACCCUCUCUCUACCUCUGGUGCAGAACUACAGCGGAAGGAAUCUCUG >hsa-mir-4315-2 MI0015983 (SEQ ID NO: 1879)
UGGGCUUUGCCCGCUUUCUGAGCUGGACCCUCUCUCUACCUCUGGUGCAGAACUACAGCGGAAGGAAUCUCUG >hsa-mir-4316 MI0015845 (SEQ ID NO: 1880)
AGUGGCCCAGGGUGAGGCUAGCUGGUGUGGUCACCCACUCUCCAGCCCCAGCCCCAAUCCCACCACAACCAC >hsa-mir-4317 MI0015850 (SEQ ID NO: 1881)
AAAAGGCGAGACAUUGCCAGGGAGUUUAUUUUGUAGCUCUCUUGAUAAAAUGUUUUAGCAAACAC >hsa-mir-4318 MI0015847 (SEQ ID NO: 1882)
GCUUCUUAAUUAUGUCAUAAACCCACUGUGGACAAGGGCCUUGUCUUAGACAGUCACUGUGGGUACAUGCUAGGUGC
UCAA >hsa-mir-4319 MI0015848 (SEQ ID NO: 1883)
UUGGCUUGAGUCCCUGAGCAAAGCCACUGGGAAUGCUCCCUGAGGACGUUAUAUGAGUGCUCAGCUCAUGGGGCUAU
GAUGGUCA >hsa-mir-4320 MI0015849 (SEQ ID NO: 1884)
GACAUGUGGGGUUUGCUGUAGACAUUUCAGAUAACUCGGGAUUCUGUAGCUUCCUGGCAACUUUG >hsa-mir-4321 MI0015852 (SEQ ID NO: 1885)
CUGGUCUCCGCAGAGCCUCUGCCCCUCCCGAGACACCCGCUACCUGGUGUUAGCGGUGGACCGCCCUGCGGGGCCU
GGC >hsa-mir-4322 MI0015851 (SEQ ID NO: 1886)
ACCGCGAGUUCCGCGCCUGGCCGUGUCGCCCCACGAGGGGGACUGUGGGCUCAGCGCGUGGGGCCCGGAGCAU >hsa-mir-4323 MI0015853 (SEQ ID NO: 1887)
CGGGGCCCAGGCGGGCAUGUGGGGUGUCUGGAGACGCCAGGCAGCCCCACAGCCUCAGACCUCGGGCAC >hsa-mir-4324 MI0015854 (SEQ ID NO: 1888)
CGGCCCCUUUGUUAAGGGUCUCAGCUCCAGGGAACUUUAAAACCCUGAGACCCUAACCUUAAAGGUGCUGCA >hsa-mir-4325 MI0015865 (SEQ ID NO: 1889)
GGGGAAGAUGUUGCACUUGUCUCAGUGAGAGAUGCUUCUAGAUCCAGGAGGCAGACCUCAAGGAUGGAGAGAAGGCA
GAUCCUUUGAGAU >hsa-mir-4326 MI0015866 (SEQ ID NO: 1890)
GCUGCUCUGCUGUUCCUCUGUCUCCCAGACUCUGGGUGGAUGGAGCAGGUCGGGGGCCA >hsa-mir-4327 MI0015867 (SEQ ID NO: 1891)
GGCCUGGGUAGGCUUGCAUGGGGGACUGGGAAGAGACCAUGAACAGGUUAGUCCAGGGAGUUCUCAUCAAGCCUUUA
CUCAGUAG >hsa-mir-4328 MI0015904 (SEQ ID NO: 1892)
AACAGUUGAGUCCUGAGAACCAUUGAGAACCAGUUUUCCCAGGAUUAACUGUUCCG >hsa-mir-4329 MI0015901 (SEQ ID NO: 1893)
UAGAGAGGAAGGUGUACCAGGGUUUUGGAGUUUUUUUUCCUCCUGAGACCCUAGUUCCACAUUCUGGAGC >hsa-mir-4330 MI0015902 (SEQ ID NO: 1894)
AAUUGUCAGCAGGCAAUUAUCUGAGGAUGCAGGAGAGGAAGGGGCUUCUUUUUGACGCCUACUUCAUCAGCUGCUC
CUCAGAUCAGAGCCUUGCAGGUCAGGCC >hsa-mir-4417 MI0016753 (SEQ ID NO: 1895)
GAAAACAACCAGGUGGGCUUCCCGGAGGGCGGAACACCCAGCCCCAGCAUCCAGGGCUCACCUACCACGUUUG >hsa-mir-4418 MI0016754 (SEQ ID NO: 1896)
UGGUUUUUGCUCUGAGUGACCGUGGUGGUUGUGGGAGUCACUGCAGGACUCAGCAGGAAUUC >hsa-mir-4419a MI0016755 (SEQ ID NO: 1897)
UGGUGGUGUGUGCCUGUAGUCUUAGCUACUCGGGAGGCUGAGGGAGGAGACUGCAGUGAGUGGAGGUCACGCCACUG >hsa-mir-4419b MI0016861 (SEQ ID NO: 1898)
CUCAGGCUCAGUGGUGCAUGCUUUAUAGUCCCAGCCACUCUGGAGGCUGAAGGAAGAUGGCUUGAGCCU >hsa-mir-4420 MI0016757 (SEQ ID NO: 1899)
CUCUUGGUAUGAACAUCUGUGUGUUCAUGUCUCUCUGUGCACAGGGGACGAGAGUCACUGAUGUCUGUAGCUGAGAC >hsa-mir-4421 MI0016758 (SEQ ID NO: 1900)
CUGGGUCUCCUUUCUGCUGAGAGUUGAACACUUGUUGGGACAACCUGUCUGUGGAAAGGAGCUACCUAC >hsa-mir-4422 MI0016759 (SEQ ID NO: 1901)
AGUUCUUCUGCAGACAAAAGCAUCAGGAAGUACCCACCAUGUACCAGUGGGCCCUUCUUGAUGCUCUUGAUUGCAGA
GGAGCC >hsa-mir-4423 MI0016760 (SEQ ID NO: 1902)
AUCAUGUACUGCAGUUGCCUUUUUGUUCCCAUGCUGUUUAAGCCUAGCAUAGGCACCAAAAAGCAACAACAGUAUGU
GAA >hsa-mir-4424 MI0016763 (SEQ ID NO: 1903)
CUUACAUCACACACAGAGUUAACUCAAAAUGGACUAAUUUUUCCACUAGUUAGUCCAUUUCAAGUUAACUCUGUGUG
UGAUGUAGU >hsa-mir-4425 MI0016764 (SEQ ID NO: 1904)
GUGCUUUACAUGAAUGGUCCCAUUGAAUCCCAACAGCUUUGCGAAGUGUUGUUGGGAUUCAGCAGGACCAUUCGUGU
AAAGUAA >hsa-mir-4426 MI0016765 (SEQ ID NO: 1905)
AGUUGGAAGAUGGACGUACUUUGUCUGACUACAAUAUUCAAAAGGAGUCUACUCUUCAUCUUG >hsa-mir-4427 MI0016766 (SEQ ID NO: 1906)
GAAGCCUCUUGGGGCUUAUUUAGACAAUGGUUUCAUCAUUUCGUCUGAAUAGAGUCUGAAGAGUCUUU >hsa-mir-4428 MI0016767 (SEQ ID NO: 1907)
UUGGCAGGUGCCAUGUUGCCUGCUCCUUACUGUACACGUGGCUGGCAAGGAGACGGGAACAUGGAGCCGCCAU >hsa-mir-4429 MI0016768 (SEQ ID NO: 1908)
AGGGAGAAAAGCUGGGCUGAGAGGCGACUGGUGUCUAAUUUGUUUGUCUCUCCAACUCAGACUGCCUGGCCCA >hsa-mir-4430 MI0016769 (SEQ ID NO: 1909)
GUGAGGCUGGAGUGAGCGGAGAUCGUACCACUGCACUCCAACCUGGUGA -continued >hsa-mir-4431 MI0016771 (SEQ ID NO: 1910)
UGGUUUGCGACUCUGAAAACUAGAAGGUUUAUGACUGGGCAUUUCUCACCCAAUGCCCAAUAUUGAACUUUCUAGUU
GUCAGAGUCAUUAACCC >hsa-mir-4432 MI0016772 (SEQ ID NO: 1911)
GCAUCUUGCAGAGCCGUUCCAAUGCGACACCUCUAGAGUGUCAUCCCCUAGAAUGUCACCUUGGAAAGACUCUGCAA
GAUGCCU >hsa-mir-4433 MI0016773 (SEQ ID NO: 1912)
CAUCCUCCUUACGUCCCACCCCCACUCCUGUUUCUGGUGAAAUAUUCAAACAGGAGUGGGGGUGGGACAUAAGGAG
GAUA >hsa-mir-4434 MI0016774 (SEQ ID NO: 1913)
UCACUUUAGGAGAAGUAAAGUAGAACUUUGGUUUUCAACUUUUCCUACAGUGU >hsa-mir-4435-1 MI0016775 (SEQ ID NO: 1914)
AGGCAGCAAAUGGCCAGAGCUCACACAGAGGGAUGAGUGCACUUCACCUGCAGUGUGACUCAGCAGGCCAACAGAUG
CUA >hsa-mir-4435-2 MI0016777 (SEQ ID NO: 1915)
GCAAAUGGCCAGAGCUCACACAGAGGGAUGAGUGCACUUCACCUGCAGUGUGACUCAGCAGGCCAACAGAUGCU >hsa-mir-4436a MI0016776 (SEQ ID NO: 1916)
GCCUACUUUUCCACUUAUGCCUGCCCUGCCCCUCGAAUCUGCUCCACGAUUUGGGCAGGACAGGCAGAAGUGGAUA
AGUGAGGA >hsa-mir-4436b-1 MI0017425 (SEQ ID NO: 1917)
GUGUCCUCACUUGUCCACUUCUGCCUGCCCUGCCCAAAUGGUGGAGCAGAUUCGAGGGGCAGGGCAGGAAGAAGUGG
ACAAGUGAGGCCAU >hsa-mir-4436b-2 MI0019110 (SEQ ID NO: 1918)
GUGUCCUCACUUGUCCACUUCUGCCUGCCCUGCCCAAAUGGUGGAGCAGAUUCGAGGGGCAGGGCAGGAAGAAGUGG
ACAAGUGAGGCCAU >hsa-mir-4437 MI0016778 (SEQ ID NO: 1919)
ACUUUGUGCAUUGGGUCCACAAGGAGGGGAUGACCCUUGUGGGCUCAGGGUACAAAGGUU >hsa-mir-4438 MI0016781 (SEQ ID NO: 1920)
UAAGUGUAAACUUAAGGACUGUCUUUUCUAAGCCUGUGCCUUGCCUUUCCUUUGGCACAGGCUUAGAAAAGACAGUC
UUUAAGUUUACACUUC >hsa-mir-4439 MI0016782 (SEQ ID NO: 1921)
CCAGUGACUGAUACCUUGGAGGCAUUUUAUCUAAGAUACACACAAAGCAAAUGCCUCUAAGGUAUCAGUUUACCAGG
CCA >hsa-mir-4440 MI0016783 (SEQ ID NO: 1922)
CUCUCACCAAGCAAGUGCAGUGGGGCUUGCUGGCUUGCACCGUGACUCCCUCUCACCAAGCAAGUGUCGUGGGGCUU
GCUGGCUUGCACUGUGAAGAU >hsa-mir-4441 MI0016784 (SEQ ID NO: 1923)
CAGAGUCUCCUUCGUGUACAGGGAGGAGACUGUACGUGAGAGAUAGUCAGAUCCGCAUGUUAGAGCAGAGUCUCCUU
CGUGUACAGGGAGGAGAUUGUAC >hsa-mir-4442 MI0016785 (SEQ ID NO: 1924)
GCGCCCUCCCUCUCUCCCCGGUGUGCAAAUGUGUGUGUGCGGUGUUAUGCCGGACAAGAGGGAGGUG >hsa-mir-4443 MI0016786 (SEQ ID NO: 1925)
GGUGGGGGUUGGAGGCGUGGGUUUUAGAACCUAUCCCUUUCUAGCCCUGAGCA >hsa-mir-4444-1 MI0016787 (SEQ ID NO: 1926)
GUGACGACUGGCCCCGCCUCUUCCUCUCGGUCCCAUAUUGAACUCGAGUUGGAAGAGGCGAGUCCGGUCUCAAA >hsa-mir-4444-2 MI0019111 (SEQ ID NO: 1927)
GUGACGACUGGCCCCGCCUCUUCCUCUCGGUCCCAUAUUGAACUCGAGUUGGAAGAGGCGAGUCCGGUCUCAAA >hsa-mir-4445 MI0016788 (SEQ ID NO: 1928)
UUCCUGCAGAUUGUUUCUUUUGCCGUGCAAGUUUAAGUUUUUGCACGGCAAAAGAAACAAUCCAGAGGGU >hsa-mir-4446 MI0016789 (SEQ ID NO: 1929)
CUGGUCCAUUUCCCUGCCAUUCCCUUGGCUUCAAUUUACUCCCAGGGCUGGCAGUGACAUGGGUCAA >hsa-mir-4447 MI0016790 (SEQ ID NO: 1930)
GUUCUAGAGCAUGGUUUCUCAUCAUUUGCACUACUGAUACUUGGGGUCAGAUAAUUGUUUGUGGUGGGGGCUGUUGU
UUGCAUUGUAGGAU >hsa-mir-4448 MI0016791 (SEQ ID NO: 1931)
AGGAGUGACCAAAAGACAAGAGUGCGAGCCUUCUAUUAUGCCCAGACAGGGCCACCAGAGGGCUCCUUGGUCUAGGG
GUAAUGCCA -continued >hsa-mir-4449 MI0016792 (SEQ ID NO: 1932)
AGCAGCCCUCGGCGGCCCGGGGGGCGGGCGGCGGUGCCCGUCCCGGGGCUGCGCGAGGCACAGGCG >hsa-mir-4450 MI0016795 (SEQ ID NO: 1933)
UGUCUGGGGAUUUGGAGAAGUGGUGAGCGCAGGUCUUUGGCACCAUCUCCCCUGGUCCCUUGGCU >hsa-mir-4451 MI0016797 (SEQ ID NO: 1934)
UCUGUACCUCAGCUUUGCUCCCAACCAACCACUUCCACAUGUUUUGCUGGUAGAGCUGAGGACAGC >hsa-mir-4452 MI0016798 (SEQ ID NO: 1935)
UGGAUCACUUGAGGCCAAGAGUGCAAGGCUGUAGUGUGCACAGCCUUGAAUUCUUGGCCUUAAGUGAUCCC >hsa-mir-4453 MI0016799 (SEQ ID NO: 1936)
UGGAGAGCUUGGUCUGUAGCGGUUUCCUUCGGGGCAGGUGGGGACUGCUCCUUUGGGAGGAAGGAGGAGGCCCAGGC
CGCGUCUUCAGG >hsa-mir-4454 MI0016800 (SEQ ID NO: 1937)
CCGGAUCCGAGUCACGGCACCAAAUUUCAUGCGUGUCCGUGUGAAGAGACCACCA >hsa-mir-4455 MI0016801 (SEQ ID NO: 1938)
AGAAGGGUGUGUGUGUUUUUCCUGAGAAUAAGAGAAGGAAGGACAGCCAAAUUCUUCA >hsa-mir-4456 MI0016802 (SEQ ID NO: 1939)
AUGAACCUGGUGGCUUCCUUUUCUGGGAGGAAGUUAGGGUUCA >hsa-mir-4457 MI0016803 (SEQ ID NO: 1940)
GGAGUACUCCAGUCAAUACCGUGUGAGUUAGAAAAGCUCAAUUCACAAGGUAUUGACUGGCGUAUUCA >hsa-mir-4458 MI0016804 (SEQ ID NO: 1941)
GAGCGCACAGAGGUAGGUGUGGAAGAAAGUGAAACACUAUUUUAGGUUUUAGUUACACUCUGCUGUGGUGUGCUG >hsa-mir-4459 MI0016805 (SEQ ID NO: 1942)
ACCCAGGAGGCGGAGGAGGUGGAGGUUGCAGUGAGCCAAGAUCGUGGCACUGACUCCAGCCUGGGG >hsa-mir-4460 MI0016806 (SEQ ID NO: 1943)
GUUUUUGCCCAUAGUGGUUGUGAAUUUACCUUCUCCUCUUUGCAGUGAUAAAGGAGGUAAAUUCACAACCACUGUG
GGCAGAAAC >hsa-mir-4461 MI0016807 (SEQ ID NO: 1944)
GAGUAGGCUUAGGUUAUGUACGUAGUCUAGGCCAUACGUGUUGGAGAUUGAGACUAGUAGGGCUAGGCCUACUG >hsa-mir-4462 MI0016810 (SEQ ID NO: 1945)
CUUCCCAGCUGCCCUAAGUCAGGAGUGGCUUUCCUGACACGGAGGGUGGCUUGGGAAA >hsa-mir-4463 MI0016811 (SEQ ID NO: 1946)
AAUAGAUUAUUGGUCACCACCUCCAGUUUCUGAAUUUGUGAGACUGGGGUGGGGCCUGAGAAUUUGC >hsa-mir-4464 MI0016812 (SEQ ID NO: 1947)
GGAACCUUAGUAAGGUUUGGAUAGAUGCAAUAAAGUAUGUCCACAGCUGAAAGGACAUACUUUAUUGCAUGUAUCCA
AACCUUACUAAUUCA >hsa-mir-4465 MI0016816 (SEQ ID NO: 1948)
CAUGUGUCCCCUGGCACGCUAUUUGAGGUUUACUAUGGAACCUCAAGUAGUCUGACCAGGGGACACAUGA >hsa-mir-4466 MI0016817 (SEQ ID NO: 1949)
ACGCGGGUGCGGGCCGGCGGGGUAGAAGCCACCCGGCCCGGCCCGGCCCGGCGA >hsa-mir-4467 MI0016818 (SEQ ID NO: 1950)
UGGUGGCGGCGGUAGUUAUGGGCUUCUCUUUCUCACCAGCAGCCCCUGGGCCGCCGCCUCCCU >hsa-mir-4468 MI0016819 (SEQ ID NO: 1951)
AGUCUUCUCCUGGGGCUUUGGUGGCUAUGGUUGACUGGGCCACUCAGAGCAGAAGGAUGAGAUG >hsa-mir-4469 MI0016820 (SEQ ID NO: 1952)
CCGACGCGGAGAGCGGCUCUAGGUGGGUUUGGCGGCGGCGAGGACACCGCCGCUCCCUCUAGGGUCGCUCGGAGCGU
GA >hsa-mir-4470 MI0016821 (SEQ ID NO: 1953)
CGAGCCUCUUUCGGCUUUCCAGUUUGUCUCGUCCUUUGGAACGUGGCAAACGUGGAAGCCGAGAGGGCUCU >hsa-mir-4471 MI0016822 (SEQ ID NO: 1954)
CCAAAUUUAAAACUUAAACCUCUACUAAGUUUCCAUGAAAAGAACCCAUGGGAACUUAGUAGAGGUUUAAGUUUUAA
AUUUGA >hsa-mir-4472-1 MI0016823 (SEQ ID NO: 1955)
UGGCAGACCCUUGCUCUCUCACUCUCCCUAAUGGGGCUGAAGACAGCUCAGGGGCAGGGUGGGGGUGUUGUUUUUG
UUU >hsa-mir-4472-2 MI0016824 (SEQ ID NO: 1956)
UGGUGGGGUGGGGGGUGUUGUUUUUGUUUUGAGACAGAGUCUUGCUCCGUCGCCCAGGCCGGAGU >hsa-mir-4473 MI0016825 (SEQ ID NO: 1957)
AAGGAACAGGGGACACUUGUAAUGGAGAACACUAAGCUAUGGACUGCUAUGGACUGCUAGUGCUCUCCGUUACAAGU
AUCCCCUGUUACCU >hsa-mir-4474 MI0016826 (SEQ ID NO: 1958)
UUGCCUACCUUGUUAGUCUCAUGAUCAGACACAAAUAUGGCUCUUUGUGGCUGGUCAUGAGGCUAACAAGGUAGGCAC >hsa-mir-4475 MI0016827 (SEQ ID NO: 1959)
AUCUCAAUGAGUGUGUGGUUCUAAAUGACUCAUAGUCAAGGGACCAAGCAUUCAUUAUGAA >hsa-mir-4476 MI0016828 (SEQ ID NO: 1960)
AAAAGCCUGUCCCUAAGUCCCUCCCAGCCUUCCAGAGUUGGUGCCAGGAAGGAUUUAGGGACAGGCUUUG >hsa-mir-4477a MI0016829 (SEQ ID NO: 1961)
UCCUCCUCCCAUCAAUCACAAAUGUCCUUAAUGGCAUUUAAGGAUUGCUAUUAAGGACAUUUGUGAUUCACGGGAGG
AGGU >hsa-mir-4477b MI0016830 (SEQ ID NO: 1962)
ACCUCCUCCCGUGAAUCACAAAUGUCCUUAAUAGCAAUCCUUAAAUGCCAUUAAGGACAUUUGUGAUUGAUGGGAGG
AGGA >hsa-mir-4478 MI0016831 (SEQ ID NO: 1963)
GGCCGAGGCUGAGCUGAGGAGCCUCCAAACCUGUAGACAGGGUCAUGCAGUACUAGGGGCGAGCCUCAUCCCCUGCA
GCCCUGGCC >hsa-mir-4479 MI0016838 (SEQ ID NO: 1964)
GAAACCAAGUCCGAGCGUGGCUGGCGCGGGAAAGUUCGGGAACGCGCGCGGCCGUGCUCGGAGCAGCGCCA >hsa-mir-4480 MI0016841 (SEQ ID NO: 1965)
GCAGAGGUGAGUUGACCUCCACAGGGCCACCCAGGGAGUAAGUAGCCAAGUGGAAGUUACUUUACCUCUGU >hsa-mir-4481 MI0016842 (SEQ ID NO: 1966)
GGAGUGGGCUGGUGGUUUUUUAAGAGGAAGGGAGACCUAAGCUAGCACAUGAGCACGCUC >hsa-mir-4482-1 MI0016843 (SEQ ID NO: 1967)
AGUGAGCAACCCAGUGGGCUAUGGAAAUGUGUGGAAGAUGGCAUUUCUAUUUCUCAGUGGGGCUCUUACC >hsa-mir-4482-2 MI0017872 (SEQ ID NO: 1968)
AAUAAAAAUUGAAUAGUGAGCAACCCAGUGGGCUAUGGAAAUGUGUGGAAGAUGGCAUUUCUAUUUCUCAGUGGGGC
UCUUACCUAUUACUCAUCAAC >hsa-mir-4483 MI0016844 (SEQ ID NO: 1969)
AAAAAACAACAUACUUAGUGCAUACCCAUAUAAUAUUAGGGGUGGUCUGUUGUUGUUUUUCU >hsa-mir-4484 MI0016845 (SEQ ID NO: 1970)
GGGUUUCCUCUGCCUUUUUUUCCAAUGAAAAUAACGAAACCUGUUAUUUCCCAUUGAGGGGGAAAAAGGCGGGAGAA
GCCCCA >hsa-mir-4485 MI0016846 (SEQ ID NO: 1971)
AGAGGCACCGCCUGCCCAGUGACAUGCGUUUAACGGCCGCGGUACCCUAACUGUGCA >hsa-mir-4486 MI0016847 (SEQ ID NO: 1972)
GCAUGCUGGGCGAGGCUGGCAUCUAGCACAGGCGGUAGAUGCUUGCUCUUGCCAUUGCAAUGA >hsa-mir-4487 MI0016848 (SEQ ID NO: 1973)
ACUGUCCUUCAGCCAGAGCUGGCUGAAGGGCAGAAGGGAACUGUCCUUCAGCCAGAGCUGGCUGAAGGGCAGA >hsa-mir-4488 MI0016849 (SEQ ID NO: 1974)
GGUAGGGGCGGGCUCCGGCGCUGGGACCCCACUAGGGUGGCGCCUUGGCCCCGCCCCGCCC >hsa-mir-4489 MI0016850 (SEQ ID NO: 1975)
GGGGGUGGGCUAGUGAUGCAGGACGCUGGGGACUGGAGAAGUCCUGCCUGACCCUGUCCCA >hsa-mir-4490 MI0016852 (SEQ ID NO: 1976)
AUAGUUUCUGCAAUGCUCAAAUCUCUGGCCAAAGACCAGAACUUAAUGGUCUCUGGUAAGAGAUUUGGGCAUAUUAG
AAACUAA >hsa-mir-4491 MI0016853 (SEQ ID NO: 1977)
ACAUUUGGUCACACCAGUCCACAUUAACGUGGACCAGACAAUAUUAAUGUGGACUGGUGUGACCAAAA >hsa-mir-4492 MI0016854 (SEQ ID NO: 1978)
CUGCAGCGUGCUUCUCCAGGCCCCGCGCGCGGACAGACACACGGACAAGUCCCGCCAGGGGCUGGGCGCGCGCCAGC
CGG >hsa-mir-4493 MI0016855 (SEQ ID NO: 1979)
CCAGAGAUGGGAAGGCCUUCCGGUGAUUAUCACAGCCAUGCCUUUACCUCCAGAAGGCCUUUCCAUCUCUGUC >hsa-mir-4494 MI0016856 (SEQ ID NO: 1980)
AGUUUUAGUUACCCUGGUCAUCUGCAGUCUGAAAAUACAAAAUGGAAAAUUCCAGACUGUGGCUGACCAGAGGUAAC
UGAAACC >hsa-mir-4495 MI0016857 (SEQ ID NO: 1981)
AAGAAAUGUAAACAGGCUUUUUGCUCAGUGGAGUUAUUUUGAGCAAAAAGCUUAUUUACAUUUCUG >hsa-mir-4496 MI0016858 (SEQ ID NO: 1982)
ACAUCAGCUCAUAUAAUCCUCGAAGCUGCCUUUAGAAAUGAGGAAACUGAAGCUGAGAGGG >hsa-mir-4497 MI0016859 (SEQ ID NO: 1983)
ACCUCCGGGACGGCUGGGCGCCGGCGGCCGGGAGAUCCGCGCUUCCUGAAUCCCGGCCGGCCCGCCCGGCGCCCGUC
CGCCCGCGGGUC >hsa-mir-4498 MI0016860 (SEQ ID NO: 1984)
AGGGCUGGGCUGGCAGGGCAAGUGCUGCAGAUCUUUGUCUAAGCAGCCCCUGCCUUGGAUCUCCCA >hsa-mir-4499 MI0016862 (SEQ ID NO: 1985)
AAGACUGAGAGGAGGGAACUGGUGAGUUGUACAUAGAAAUGCUUUCUAACUCCUUGUCUCAGUCUGUUU >hsa-mir-4500 MI0016863 (SEQ ID NO: 1986)
CAGGAGAGAAAGUACUGCCCAGAAGCUAAAGUGUAGAUCAAACGCAUAAUGGCUGAGGUAGUAGUUUCUUGAACUU >hsa-mir-4501 MI0016864 (SEQ ID NO: 1987)
UAUGUGACCUCGGAUGAAUCACUGAAAUAUGUCUGAGCUUCUGUUUCAUCAGAUGUCACAUUUU >hsa-mir-4502 MI0016865 (SEQ ID NO: 1988)
AGCCUUUAGCAAGUUGUAAUCUUUUUGCUGAUGGAGGGUCUUGCCUCCAUGGGGAUGGCUGAUGAUGAUGGUGCUGA
AGGC >hsa-mir-4503 MI0016866 (SEQ ID NO: 1989)
ACAAUGUAGAUAUUUAAGCAGGAAAUAGAAUUUACAUAUAAAUUUCUAUUUGUUUCUAUUUCCUGCUUAAAUAUCUA
CAUUGC >hsa-mir-4504 MI0016867 (SEQ ID NO: 1990)
CUAAGAUAAUGUCCUCCAGGUUCAUCUCUGUUGUCAUUUGUGGCAUGGACCAUUUGUGACAAUAGAGAUGAACAUGG
AGGAUAUUAUCUUAA >hsa-mir-4505 MI0016868 (SEQ ID NO: 1991)
GGAGGCUGGGCUGGGACGGACACCCGGCCUCCACUUUCUGUGGCAGGUACCUCCUCCAUGUCGGCCCGCCUUG >hsa-mir-4506 MI0016869 (SEQ ID NO: 1992)
UGGCCUCUGCCAUCAGACCAUCUGGGUUCAAGUUUGGCUCCAUCUUUAUGAAAUGGGUGGUCUGAGGCAAGUGGUCU >hsa-mir-4507 MI0016871 (SEQ ID NO: 1993)
UCUGGGCUGAGCCGAGCUGGGUUAAGCCGAGCUGGGUUGGGCUGGGCUGGGU >hsa-mir-4508 MI0016872 (SEQ ID NO: 1994)
AGGACCCAGCGGGGCUGGGCGCGCGGAGCAGCGCUGGGUGCAGCGCCUGCGCCGGCAGCUGCAAGGGCCG >hsa-mir-4509-1 MI0016873 (SEQ ID NO: 1995)
CUUUAAUACUAUCUCAAACUAAAGGAUAUAGAAGGUUUUCCCUUUCUCUUGCCCUGAAACCUUCUGUAUCCUUUAUU
UUGAGAUAGUAUUAGAA >hsa-mir-4509-2 MI0016874 (SEQ ID NO: 1996)
CUUUAAUACUAUCUCAAACUAAAGGAUAUAGAAGGUUUUCCCUUUCUCUUGCCCUGAAACCUUCUGUAUCCUUUAUU
UUGAGAUAGUAUUAGAA >hsa-mir-4509-3 MI0016875 (SEQ ID NO: 1997)
CUUUAAUACUAUCUCAAACUAAAGGAUAUAGAAGGUUUUCCCUUUCUCUUGCCCUGAAACCUUCUGUAUCCUUUAUU
UUGAGAUAGUAUUAGAA >hsa-mir-4510 MI0016876 (SEQ ID NO: 1998)
GUGUAUGUGAGGGAGUAGGAUGUAUGGUUGUUAGAUAGACAACUACAAUCUUUUCUCACAACAGACAG >hsa-mir-4511 MI0016877 (SEQ ID NO: 1999)
AAAAAAAGGGAAAGAAGAACUGUUGCAUUUGCCCUGCACUCAGUUUGCACAGGGUAAAUGCAAUAGUUCUUCUUUC
CCUUUUUUUA >hsa-mir-4512 MI0016878 (SEQ ID NO: 2000)
CUCAGCCCGGGCAAUAUAGUGAGACCUCGUCUCUACAAAAAAUUGAGACAGGGCCUCACUGUAUCGCCCAGGCUGGA >hsa-mir-4513 MI0016879 (SEQ ID NO: 2001)
AUUCUAGGUGGGGAGACUGACGGCUGGAGGCCCAUAAGCUGUCUAAAACUUCGGCCCCCAGAUUUCUGGUCUCCCCA
CUUCAGAAC >hsa-mir-4514 MI0016880 (SEQ ID NO: 2002)
GUUGAGACAGGCAGGAUUGGGGAAACAUCUUUUACCUCGUCUCUUGCCUGUUUUAGA >hsa-mir-4515 MI0016881 (SEQ ID NO: 2003)
GCGGGAGGUGUAACAGGACUGGACUCCCGGCAGCCCCAGGGCAGGGGCGUGGGGAGCUGGUCCUAGCUCAGCGCUCC
CGGA >hsa-mir-4516 MI0016882 (SEQ ID NO: 2004)
AGGGAGAAGGGUCGGGGCAGGGAGGGCAGGGCAGGCUCUGGGGUGGGGGUCUGUGAGUCAGCCACGGCUCUGCCCA
CGUCUCCCC >hsa-mir-4517 MI0016883 (SEQ ID NO: 2005)
AGGUAAAUAUGAUGAAACUCACAGCUGAGGAGCUUAGCAAGUAGCUAAGGCCAGAGCUUGUGUUUGGGUGGUGUGGC
UG >hsa-mir-4518 MI0016884 (SEQ ID NO: 2006)
UGGGGGAAAAGUGCUGGGAUUGAUUAGUGAUGUCUGCUGGGGAACCGGGGCUCAGGGAUGAUAACUGUGCUGAGAAG
CCCCCU >hsa-mir-4519 MI0016885 (SEQ ID NO: 2007)
AACCUCAGCAGUGCGCAGGGCUGCACUGUCUCCGUCUGCGGCCUGCAGUAAGCGGGUA >hsa-mir-4520a MI0016886 (SEQ ID NO: 2008)
GUGUGCCACCUGCGUGUUUUCUGUCCAAAUCAGAAAAGGAUUUGGACAGAAAACACGCAGGAAGAAGGAA >hsa-mir-4520b MI0017358 (SEQ ID NO: 2009)
CCUGCGUGUUUUCUGUCCAAAUCCUUUUCUGAUUUGGACAGAAAACACGCAGGU >hsa-mir-4521 MI0016887 (SEQ ID NO: 2010)
UCGGCUAAGGAAGUCCUGUGCUCAGUUUUGUAGCAUCAAAACUAGGAUUUCUCUUGUUAC >hsa-mir-4522 MI0016889 (SEQ ID NO: 2011)
GCGGGCGUUGCCUGGGGGCCUCGCAGGGGGAGAUCCAGCCCAGGCUGGUUCCGCUGACUCUGCCUGUAGGCCGGUGG
CGUCUUCUGG >hsa-mir-4523 MI0016890 (SEQ ID NO: 2012)
GCGGGGACCGAGAGGGCCUCGGCUGUGUGAGGACUAGAGGCGGCCGAGGCCCGGGCCGGUUCCCCCGA >hsa-mir-4524a MI0016891 (SEQ ID NO: 2013)
GAACGAUAGCAGCAUGAACCUGUCUCACUGCAGAAUUAUUUGAGACAGGCUUAUGCUGCUAUCCUUCA >hsa-mir-4524b MI0019114 (SEQ ID NO: 2014)
UAGCUGGGUGGAUGUGUUCUUUUGAAGGAUAGCAGCAUAAGCCUGUCUCAAAAUAAUUCUGCAGUGAGACAGGUUCA
UGCUGCUAUCGUUCCAAAGAGGAAGGGUAAUCACUGUC >hsa-mir-4525 MI0016892 (SEQ ID NO: 2015)
GUCAGAGGGGGAUGUGCAUGCUGGUUGGGGUGGGCUGCCUGUGGACCAAUCAGCGUGCACUUCCCCACCCUGAA >hsa-mir-4526 MI0016893 (SEQ ID NO: 2016)
UGCGGUGACAUCAGGGCCCAGUCCCUGCUGUCAUGCCCCAGGUGACGUGCUGGGCUGACAGCAGGGCUGGCCGCUAA
CGUCACUGUC >hsa-mir-4527 MI0016894 (SEQ ID NO: 2017)
CCAGAAGUGGUCUGCAAAGAGAUGACUGUGAAUCCAAGAUCCACAUCAGCUCUGUGCUGCCUACAUCUGA >hsa-mir-4528 MI0016895 (SEQ ID NO: 2018)
UAUUCUACUGAGAGUACAGAUCUUUAUAUAUAUGAUCAUUAUAUGUAUGAUGAGAUCAUUAUAUGUAUGAUCUGGAC
ACCCAGUAGAAUC >hsa-mir-4529 MI0016896 (SEQ ID NO: 2019)
AUGACAGGCCAUCAGCAGUCCAAUGAAGACAUGAAGACCCAAUGUCUUCAUUGGACUGCUGAUGGCCCGUCACUGGGA >hsa-mir-4530 MI0016897 (SEQ ID NO: 2020)
CGACCGCACCCGCCCGAAGCUGGGUCAAGGAGCCCAGCAGGACGGGAGCGCGGCGC >hsa-mir-4531 MI0016898 (SEQ ID NO: 2021)
GCCUAGGAGUCCUUGGUCAGUGGGGACAUGGAGAAGGCUUCUGAGGA >hsa-mir-4532 MI0016899 (SEQ ID NO: 2022)
ACAGACCCCGGGGAGCCCGGCGGUGAAGCUCCUGGUAUCCUGGGUGUCUGA >hsa-mir-4533 MI0016900 (SEQ ID NO: 2023)
UGAGAAUGUGGAAGGAGGUUGCCGGACGCUGCUGGCUGCCUUCCAGCGUCCACUUCCCUUUCUCUCUCCC >hsa-mir-4534 MI0016901 (SEQ ID NO: 2024)
UGUGAAUGACCCCCUUCCAGAGCCAAAAUCACCAGGGAUGGAGGAGGGGUCUUGGGUACU >hsa-mir-4535 MI0016903 (SEQ ID NO: 2025)
AACUGGGUCCCAGUCUUCACAGUUGGUUUCUGACACGUGGACCUGGCUGGGACGAUGUG >hsa-mir-4536-1 MI0016906 (SEQ ID NO: 2026)
AUGUGGUAGAUAUAUGCACGAUAUAUAUACUGCCCUGCUUUUAUACAUACAUACAUACCUAUAUCGUGCAUAU
AUCUACCACAU >hsa-mir-4536-2 MI0019149 (SEQ ID NO: 2027)
AUGUGGUAGAUAUAUGCACGAUAUAGGUAUGUAUGUAUGUAUGUAUAAAAGCAGGGCAGUAUAUAUAUCGUGCAUAU
AUCUACCACAU >hsa-mir-4537 MI0016908 (SEQ ID NO: 2028)
UGAGCCGAGCUGAGCUUAGCUGGGCUGAGCUAACCAGGGCUGGGCUGAGCUGGGCUGAGCUGAGCUGAGC >hsa-mir-4538 MI0016909 (SEQ ID NO: 2029)
GAGCUUGGAUGAGCUGGGCUGAACUGGGCUGGGUUGAGCUGGGCUGGGCUGAGUUGAGCCAGGCUGAUCUGGGCUGAG >hsa-mir-4539 MI0016910 (SEQ ID NO: 2030)
UGAGCUGGGCUCUGCUGUGCUGUGCUGAGCAGGGCUGAGCUGAACUGGGCUGAGCUGGGC >hsa-mir-4540 MI0016911 (SEQ ID NO: 2031)
AAGCUGCAUGGACCAGGACUUGGCACCUUUGGCCUUAGUCCUGCCUGUAGGUUUA >hsa-mir-4632 MI0017259 (SEQ ID NO: 2032)
GAGGGCAGCGUGGGUGUGGCGGAGGCAGGCGUGACCGUUUGCCGCCCUCUCGCUGCUCUAG >hsa-mir-4633 MI0017260 (SEQ ID NO: 2033)
UGGCAAGUCUCCGCAUAUGCCUGGCUAGCUCCUCCACAAAUGCGUGUGGAGGAGCUAGCCAGGCAUAUGCAGAGCGU
CA >hsa-mir-4634 MI0017261 (SEQ ID NO: 2034)
GGACAAGGGCGGCGCGACCGGCCCGGGGCUCUUGGGCGGCCGCGUUUCCCCUCC >hsa-mir-4635 MI0017262 (SEQ ID NO: 2035)
CCGGGACUUUGUGGGUUCUGACCCCACUUGGAUCACGCCGACAACACUGGUCUUGAAGUCAGAACCCGCAAAGUCCU
GG >hsa-mir-4636 MI0017263 (SEQ ID NO: 2036)
UAGAUUCAGAACUCGUGUUCAAAGCCUUUAGCCCAGCAAUGGGAGAGUGCUAAAGGCUUCAAGCACGAGUUCUGAAU
CUA >hsa-mir-4637 MI0017264 (SEQ ID NO: 2037)
CCCUUACUUGGAUCUGCAAUUAGUAUUUUAAUCAUAGAUUGUAUUUAGUUAGUUUUUAAUACUAACUGCAGAUUCAA
GUGAGGG >hsa-mir-4638 MI0017265 (SEQ ID NO: 2038)
GACUCGGCUGCGGUGGACAAGUCCGGCUCCAGAACCUGGACACCGCUCAGCCGGCCGCGGCAGGGGUC >hsa-mir-4639 MI0017266 (SEQ ID NO: 2039)
UUGCUAAGUAGGCUGAGAUUGAUGUCAGGUUAUCCCCAAGCAUAACCUCACUCUCACCUUGCUUUGCAG >hsa-mir-4640 MI0017267 (SEQ ID NO: 2040)
CUGUGGGCUGGGCCAGGGAGCAGCUGGUGGGUGGGAAGUAAGAUCUGACCUGGACUCCAUCCCACCCACCCCCUGUU
UCCUGGCCCACAG >hsa-mir-4641 MI0017268 (SEQ ID NO: 2041)
GGGGGGCAGGGGCAGAGGGCAUCAGAGGACAGCCGCCUGGUGCCCAUGCCAUACUUUUGCCUCAG >hsa-mir-4642 MI0017269 (SEQ ID NO: 2042)
CACAACUGCAUGGCAUCGUCCCCUGGUGGCUGUGGCCUAGGGCAAGCCACAAAGCCACUCAGUGAUGAUGCCAGCAG
UUGUG >hsa-mir-4643 MI0017270 (SEQ ID NO: 2043)
GUGUGCCCUAGCAUUUAUAAUCAUGUGUUCAUUCACAUGAUCAUAAGUGGACACAUGACCAUAAAUGCUAAAGCACAC >hsa-mir-4644 MI0017271 (SEQ ID NO: 2044)
GCGGCGGUGCUCUGCCUCUUUCUCCAUCCACCCUGGUCCAGGUCCACAGCAGUGGAGAGAGAAAAGAGACAGAAGGA
UGGCCGU >hsa-mir-4645 MI0017272 (SEQ ID NO: 2045)
UGAUAGGGAAACCAGGCAAGAAAUAUUGUCUCCCUCAAGUUGCGACGAGACAGUAGUUCUUGCCUGGUUUCUCUAUCA >hsa-mir-4646 MI0017273 (SEQ ID NO: 2046)
ACUGGGAAGAGGAGCUGAGGGACAUUGCGGAGAGGGUCUCACAUUGUCCCUCUCCCUUCCCAG >hsa-mir-4647 MI0017274 (SEQ ID NO: 2047)
CCAGGAGGGUGAAGAUGGUGCUGUGCUGAGGAAAGGGGAUGCAGAGCCCUGCCCAGCACCACCACCUCCUAUGCUCC
UGG >hsa-mir-4648 MI0017275 (SEQ ID NO: 2048)
UGUGGGACUGCAAAUGGGAGCUCAGCACCUGCCUGCCACCCACGCAGACCAGCCCCUGCUCUGUUCCCACAG >hsa-mir-4649 MI0017276 (SEQ ID NO: 2049)
UCUGGGCGAGGGGUGGGCUCUCAGAGGGGCUGGCAGUACUGCUCUGAGGCCUGCCUCUCCCCAG >hsa-mir-4650-1 MI0017277 (SEQ ID NO: 2050)
UUCUGUAGAGAUUAUCAGGCCUCUUUCUACCUUCCAAGGCUCAGAAGGUAGAAUGAGGCCUGACAUAUCUGCAGGA >hsa-mir-4650-2 MI0017278 (SEQ ID NO: 2051)
UUCUGUAGAGAUUAUCAGGCCUCUUUCUACCUUCCAAGGCUCAGAAGGUAGAAUGAGGCCUGACAUAUCUGCAGGA >hsa-mir-4651 MI0017279 (SEQ ID NO: 2052)
CGGCGACGGCGGGGUGGGUGAGGUCGGGCCCCAAGACUCGGGGUUUGCCGGGCGCCUCAGUUCACCGCGGCCG >hsa-mir-4652 MI0017280 (SEQ ID NO: 2053)
UAUUGGACGAGGGGACUGGUUAAUAGAACUAACUAACCAGAACUAUUUGUUCUGUUAACCCAUCCCCUCAUCUAAUA >hsa-mir-4653 MI0017281 (SEQ ID NO: 2054)
UUGUCCAAUUCUCUGAGCAAGGCUUAACACCAAAGGGUUAAGGGUUUGCUCUGGAGUUAAGGGUUGCUUGGAGAAUU
GGAGAA >hsa-mir-4654 MI0017282 (SEQ ID NO: 2055)
CUGGCUGGUUGUGGGAUCUGGAGGCAUCUGGGGUUGGAAUGUGACCCCAGUCUCCUUUUCCCUCAUCAUCUGCCAG >hsa-mir-4655 MI0017283 (SEQ ID NO: 2056)
CCAAGGGCACACCGGGGAUGGCAGAGGGUCGUGGGAAAGUGUUGACCCUCGUCAGGUCCCCGGGGAGCCCCUGG >hsa-mir-4656 MI0017284 (SEQ ID NO: 2057)
AGGCUGGCGUGGGCUGAGGGCAGGAGGCCUGUGGCCGGUCCCAGGCCUCCUGCUUCCUGGGCUCAGGCUCGGUUU >hsa-mir-4657 MI0017285 (SEQ ID NO: 2058)
AAUGUGGAAGUGGUCUGAGGCAUAUAGAGUAUAUGCCAAGAACACUACCAUAU >hsa-mir-4658 MI0017286 (SEQ ID NO: 2059)
GCUGCCCUUCACUCAGAGCAUCUACACCCACUACCGGUGAGUGUGGAUCCUGGAGGAAUCGUGGC >hsa-mir-4659a MI0017287 (SEQ ID NO: 2060)
GAAACUGCUGAAGCUGCCAUGUCUAAGAAGAAAACUUUGGAGAAAAAUUUUCUUCUUAGACAUGGCAACGUCAACAG
UUUC >hsa-mir-4659b MI0017291 (SEQ ID NO: 2061)
CUGUUGACGUUGCCAUGUCUAAGAAGAAAAUUUUUCUCCAAAGUUUUCUUCUUAGACAUGGCAGCUUCAGCAG >hsa-mir-4660 MI0017288 (SEQ ID NO: 2062)
ACUCCUUCUGCAGCUCUGGUGGAAAAUGGAGAAGACUUUUCCUUUCCUCCAUCUCCCCCAGGGCCUGGUGGAGU >hsa-mir-4661 MI0017289 (SEQ ID NO: 2063)
UUUACUCUGAACUAGCUCUGUGGAUCCUGACAGACAGCCUGAUAGACAGGAUCCACAGAGCUAGUCCAGAGUAAA >hsa-mir-4662a MI0017290 (SEQ ID NO: 2064)
UCUAUUUAGCCAAUUGUCCAUCUUUAGCUAUUCUGAAUGCCUAAAGAUAGACAAUUGGCUAAAUAGA >hsa-mir-4662b MI0017293 (SEQ ID NO: 2065)
CACAAUUUCUAUUUAGCCAAUUGUCUAUCUUUAGGCAUUCAGAAUAGCUAAAGAUGGACAAUUGGCUAAAUAGACAC
UGUG >hsa-mir-4663 MI0017292 (SEQ ID NO: 2066)
CUGUGGUGGAGCUGAGCUCCAUGGACGUGCAGUGGCAUCUGUCAUUGCUGCCUUCCUGGAGCUCAGGCCCUUGCAG >hsa-mir-4664 MI0017294 (SEQ ID NO: 2067)
GUUGGGGCUGGGGUGCCCACUCCGCAAGUUAUCACUGAGCGACUUCCGGUCUGUGAGCCCCGUCCUCCGC >hsa-mir-4665 MI0017295 (SEQ ID NO: 2068)
CUCGAGGUGCUGGGGGACGCGUGAGCGCGAGCCGCUUCCUCACGGCUCGGCCGCGGCGCGUAGCCCCCGCCACAUCG
GG >hsa-mir-4666a MI0017296 (SEQ ID NO: 2069)
AUCACUUAAAUACAUGUCAGAUUGUAUGCCUACAAAAUCCCUCCAGACUGGCAUACAAUCUGACAUGUAUUUAAGAG
AU >hsa-mir-4666b MI0019299 (SEQ ID NO: 2070)
UGUCUAAAUUGCAUGUCAGAUUGUAAUUCCCAGGCCCUUCCUCCAAUACUGGGAAUUACAAUUUGACAUGCAAUUUA
GACA >hsa-mir-4667 MI0017297 (SEQ ID NO: 2071)
UGACUGGGGAGCAGAAGGAGAACCCAAGAAAAGCUGACUUGGAGGUCCCUCCUUCUGUCCCCACAG >hsa-mir-4668 MI0017298 (SEQ ID NO: 2072)
AGGGAAAAAAAAAAGGAUUUGUCUUGUAGCCAGGAUAUUGUUUUAAAGAAAAUCCUUUUUGUUUUUCCAG >hsa-mir-4669 MI0017300 (SEQ ID NO: 2073)
GCCUCCCUUCACUUCCUGGCCAUCCAGGCAUCUGUGUCUGUGUCCGGGAAGUGGAGGAGGGC >hsa-mir-4670 MI0017301 (SEQ ID NO: 2074)
CUCUAGGAAGCGACCAUGAUGUAACUUCACAGACUCUCCAAAAGUCUGAAGUUACAUCAUGGUCGCUUCCUAGAG >hsa-mir-4671 MI0017302 (SEQ ID NO: 2075)
UAUUUUAAGACCGAAGACUGUGCGCUAAUCUCUUAGCACUGAAGAUUAGUGCAUAGUCUUUGGUCUCAAAAUA >hsa-mir-4672 MI0017303 (SEQ ID NO: 2076)
GGCUGCUUCUCGCCUCUGUCCAGCUGUGUGGCCUUGGACAAGCCUCUUGGUUACACAGCUGGACAGAGGCACGAAAC
AGCC >hsa-mir-4673 MI0017304 (SEQ ID NO: 2077)
GUCCAGGCAGGAGCCGGACUGGACCUCAGGGAAGAGGCUGACCCGGCCCCUCUUGCGGC >hsa-mir-4674 MI0017305 (SEQ ID NO: 2078)
CCCAGGCGCCCGCUCCCGACCCACGCCGCGCCGCCGGGUCCCUCCUCCCCGGAGAGGCUGGGCUCGGGACGCGCGGC
UCAGCUCGGG >hsa-mir-4675 MI0017306 (SEQ ID NO: 2079)
CAUGAGAAAUCCUGCUGGUCAACCAUAGCCCUGGUCAGACUCUCCGGGGCUGUGAUUGACCAGCAGGACUUCUCAUG >hsa-mir-4676 MI0017307 (SEQ ID NO: 2080)
UGAAUGAAAGAGCCAGUGGUGAGACAGUGAGUUGAUUACUUCUCACUGUUUCACCACUGGCUCUUUGGUUCA >hsa-mir-4677 MI0017308 (SEQ ID NO: 2081)
GCAAAGCAGCAAUUGUUCUUUGGUCUUUCAGCCAUGACCUGACCUUCUGUCUGUGAGACCAAAGAACUACUUUGCUU
GGC >hsa-mir-4678 MI0017309 (SEQ ID NO: 2082)
GGAAAAAACAAGGUAUUGUUCAGACUUAUGAUUUUGGGGUCAAAGAUUCUGAGCAAUAACCUAUUAAAAAACC >hsa-mir-4679-1 MI0017310 (SEQ ID NO: 2083)
GUCUUUUUCUGUGAUAGAGAUUCUUUGCUUUGUUAGAAACAAAAAGCAAAGAAUCUCUAUCACAGAAAAAAGAU >hsa-mir-4679-2 MI0017311 (SEQ ID NO: 2084)
UAUCUUUUUCUGUGAUAGAGAUUCUUUGCUUUUUGUUUCUAACAAAGCAAAGAAUCUCUAUCACAGAAAAAAGACG >hsa-mir-4680 MI0017312 (SEQ ID NO: 2085)
UAUAAGAACUCUUGCAGUCUUAGAUGUUUAUAAAAAUAUAUCUGAAUUGUAAGAGUUGUUAGCAC >hsa-mir-4681 MI0017313 (SEQ ID NO: 2086)
GGCAACGGGAAUGCAGGCUGUAUCUGCAGGGCAUUGUGCUAACAGGUGCAGGCUGCAGACCUGUCACAGGCC >hsa-mir-4682 MI0017314 (SEQ ID NO: 2087)
UGCCCCUGGUCUGAGUUCCUGGAGCCUGGUCUGUCACUGGGGAAGUCCAGAGCUCCAAGGCUCAGUGCCCAGGGGAC
GCA >hsa-mir-4683 MI0017315 (SEQ ID NO: 2088)
GACACGCAAGACGAGGCGGGCCUGGAGGUGCACCAGUUCUGGCCGCUGGUGGAGAUCCAGUGCUCGCCCGAUCUCAA
GUUC >hsa-mir-4684 MI0017316 (SEQ ID NO: 2089)
GCACCAGGGGUACCUCUCUACUGACUUGCAACAUACAUUUGUCUUGGUGUGUUGCAAGUCGGUGGAGACGUACCCUU
GGUGC >hsa-mir-4685 MI0017317 (SEQ ID NO: 2090)
UAGCCCAGGGCUUGGAGUGGGCAAGGUUGUUGGUGAUAUGGCUUCCUCUCCCUUCCUGCCCUGGCUAG >hsa-mir-4686 MI0017318 (SEQ ID NO: 2091)
GGCUUCCUGUAUCUGCUGGGCUUUCUGGUGUUGGCAGCCCAAGAUGACACCCUGGGCCCAGCAGGAGCCAGAAGCC >hsa-mir-4687 MI0017319 (SEQ ID NO: 2092)
ACCUGAGGAGCCAGCCCUCCUCCCGCACCCAAACUUGGAGCACUUGACCUUUGGCUGUUGGAGGGGGCAGGCUCGCG
GGU >hsa-mir-4688 MI0017321 (SEQ ID NO: 2093)
GUCUACUCCCAGGGUGCCAAGCUGUUUCGUGUUCCCUCCCUAGGGGAUCCCAGGUAGGGGCAGCAGAGGACCUGGGC
CUGGAC >hsa-mir-4689 MI0017322 (SEQ ID NO: 2094)
GGUUUCUCCUUGAGGAGACAUGGUGGGGGCCGGUCAGGCAGCCCAUGCCAUGUGUCCUCAUGGAGAGGCC >hsa-mir-4690 MI0017323 (SEQ ID NO: 2095)
GAGCAGGCGAGGCUGGGCUGAACCCGUGGGUGAGGAGUGCAGCCCAGCUGAGGCCUCUGC >hsa-mir-4691 MI0017324 (SEQ ID NO: 2096)
GGAGCACUCCCAGGUCCUCCAGGCCAUGAGCUGCGGCCCUGAUGUCUCUACUCCAGCCACGGACUGAGAGUGCAUAG
GAGUGUCC >hsa-mir-4692 MI0017325 (SEQ ID NO: 2097)
GUUUUACUUGAUACCCACACUGCCUGGGUGGGACACUCAGGCAGUGUGGGUAUCAGAUAAAAC >hsa-mir-4693 MI0017326 (SEQ ID NO: 2098)
GUUUAAAGAAUACUGUGAAUUUCACUGUCACAAAUUCAAAUAAAGUGAGAGUGGAAUUCACAGUAUUUAAGGAAU >hsa-mir-4694 MI0017327 (SEQ ID NO: 2099)
CAAAUACAUAGGUGUUAUCCUAUCCAUUUGCCUCUCUCAGAAAAUAGAGUCAAAUGGACAGGAUAACACCUAUGUAU
UUG >hsa-mir-4695 MI0017328 (SEQ ID NO: 2100)
CCUGCAGGAGGCAGUGGGCGAGCAGGCGGGGCAGCCCAAUGCCAUGGGCCUGAUCUCACCGCUGCCUCCUUCCC >hsa-mir-4696 MI0017329 (SEQ ID NO: 2101)
CAAAGCCACUGCAAGACGGAUACUGUCAUCUAUUCCAGAAGAUGACAAUGUCCAUUUUGCAGUGGCUUUG >hsa-mir-4697 MI0017330 (SEQ ID NO: 2102)
GGGCCCAGAAGGGGGCGCAGUCACUGACGUGAAGGGACCACAUCCCGCUUCAUGUCAGUGACUCCUGCCCCUUGGUCU >hsa-mir-4698 MI0017331 (SEQ ID NO: 2103)
UGCUUCUCCUGGGGUCUUCCUCUACAUUUCCACCUAGACGGGCCUGGGUCAAAAUGUAGAGGAAGACCCCAGAAGGA
GCA >hsa-mir-4699 MI0017332 (SEQ ID NO: 2104)
AGCAAUUGGAGAAGAUUGCAGAGUAAGUUCCUGAUUAAGAAAUGGAAUUUACUCUGCAAUCUUCUCCAAUUGCU >hsa-mir-4700 MI0017333 (SEQ ID NO: 2105)
UCAGUGAGGUCUGGGGAUGAGGACAGUGUGUCCUGAAAUUCACAGGACUGACUCCUCACCCCAGUGCACGAGGA >hsa-mir-4701 MI0017334 (SEQ ID NO: 2106)
CCUUGGCCACCACACCUACCCCUUGUGAAUGUCGGGCAAUGGUGAUGGGUGUGGUGUCCACA >hsa-mir-4703 MI0017336 (SEQ ID NO: 2107)
UUAUGCAUAUUAGCAAUACAGUACAAAUAUAGUGUGUUUGAUUUGCACUGUAGUUGUAUUGUAUUGCCACUCUGUAU
AA >hsa-mir-4704 MI0017337 (SEQ ID NO: 2108)
CUUAUCCUAGACACUAGGCAUGUGAGUGAUUGUCUUCCUCACUCAAUCAGUCACAUAUCUAGUGUCUAGAAUGAG >hsa-mir-4705 MI0017338 (SEQ ID NO: 2109)
CUCACAAGAUCAAUCACUUGGUAAUUGCUGUGAUAACAACUCAGCAAUUACCAAGUGAUUGGUUUUGUGAG >hsa-mir-4706 MI0017339 (SEQ ID NO: 2110)
GCUACGGGGAGCGGGGAGGAAGUGGGCGCUGCUUCUGCGUUAUCUGGAAGGAGCAGCCCACUCCUGUCCUGGGCUCU
GUGGU >hsa-mir-4707 MI0017340 (SEQ ID NO: 2111)
GGUUCCGGAGCCCCGGCGCGGGCGGGUUCUGGGGUGUAGACGCUGCUGGCCAGCCCGCCCCAGCCGAGGUUCUCGGC
ACC >hsa-mir-4708 MI0017341 (SEQ ID NO: 2112)
UUUAGGAGAGAGAUGCCGCCUUGCUCCUUGAACAGGAGGAGCAAGGCGGCAUCUCUCUGAUACUAAA >hsa-mir-4709 MI0017342 (SEQ ID NO: 2113)
CUGCUUCAACAACAGUGACUUGCUCUCCAAUGGUAUCCAGUGAUUCGUUGAAGAGGAGGUGCUCUGUAGCAG >hsa-mir-4710 MI0017344 (SEQ ID NO: 2114)
GACCGAGUGGGGUGAGGGCAGGUGGUUCUUCCCGAAGCAGCUCUCGCCUCUUCGUC >hsa-mir-4711 MI0017345 (SEQ ID NO: 2115)
AAAUGUGCAUCAGGCCAGAAGACAUGAGCCCUUUGGAAAGGUCUCGUGUCUUCUGGCUUGAUGCACAUUU >hsa-mir-4712 MI0017346 (SEQ ID NO: 2116)
GACAGGAUUCCAGUACAGGUCUCUCAUUUCCUUCAUGAUUAGGAAUACUACUUUGAAAUGAGAGACCUGUACUGUAU
CUGUU >hsa-mir-4713 MI0017347 (SEQ ID NO: 2117)
GUCCCCAUUUUCUCCCACUACCAGGCUCCCAUAAGGGUCGAAUGGGAUCCAGACAGUGGGAGAAAAAUGGGGAC >hsa-mir-4714 MI0017348 (SEQ ID NO: 2118)
AUUUGGCCAACUCUGACCCCUUAGGUUGAUGUCAGAAUGAGGUGUACCAACCUAGGUGGUCAGAGUUGGCCAAAAU >hsa-mir-4715 MI0017349 (SEQ ID NO: 2119)
GGGGAAUGAAAGUUGGCUGCAGUUAAGGUGGCUAAUCAGCUGAUGGUGCCACCUUAACUGCAGCCAAUUCUAAUUCC
CC >hsa-mir-4716 MI0017350 (SEQ ID NO: 2120)
CAUACUUUGUCUCCAUGUUUCCUUCCCCCUUCUGUAUACAUGUAUACAGGAGGAAGGGGAAGGAAACAUGGAGACA
AAGUGUG >hsa-mir-4717 MI0017352 (SEQ ID NO: 2121)
GGCAGUGUUUAGGCCACAGCCACCCAUGUGUAGGGGUGGCUACACAUGGGUGGCUGUGGCCUAAACACUGCC >hsa-mir-4718 MI0017353 (SEQ ID NO: 2122)
AGCUGUACCUGAAACCAAGCACCUGUUUGUGACUUGGCUUCAGUUACUAGC >hsa-mir-4719 MI0017354 (SEQ ID NO: 2123)
ACAAUGAUGACUUGUAUGUUAUAGAUUUGUGAUUACAUUAAAACUUAAAAUUUCACAAAUCUAUAAUAUGCAGGUCA
UCACUGU >hsa-mir-4720 MI0017355 (SEQ ID NO: 2124)
AAGCCUGGCAUAUUUGGUAUAACUUAAGCACCAGGUAAAAUCUGGUGCUUAAGUUGUACCAAGUAUAGCCAAGUUU >hsa-mir-4721 MI0017356 (SEQ ID NO: 2125)
GGGCCUGGUCAUGGUCAAGCCAGGUUCCAUCAAGCCCCACCAGAAGGUGGAGGCCCAGGUGAGGGCUCCAGGUGACG
GUGGGCAGGGUU >hsa-mir-4722 MI0017357 (SEQ ID NO: 2126)
GGCAGGAGGGCUGUGCCAGGUUGGCUGGGCCAGGCCUGACCUGCCAGCACCUCCCUGCAG >hsa-mir-4723 MI0017359 (SEQ ID NO: 2127)
AGUUGGUGGGGAGCCAUGAGAUAAGAGCACCUCCUAGAGAAUGUUGAACUAAAGGUGCCCUCUCUGGCUCCUCCCC
AAAG >hsa-mir-4724 MI0017361 (SEQ ID NO: 2128)
ACGCAAAAUGAACUGAACCAGGAGUGAGCUUCGUGUACAUUAUCUAUUGAAAAUGAAGUACCUUCUGGUUCAGCUA
GUCCCUGUGCGU >hsa-mir-4725 MI0017362 (SEQ ID NO: 2129)
GUGUCUCUCUGGAGACCCUGCAGCCUUCCCACCCACCAGGGAGCUUUCCAUGGGCUGUGGGGAAGGCGUCAGUGUCG
GGUGAGGGAACAC >hsa-mir-4726 MI0017363 (SEQ ID NO: 2130)
AGGGCCAGAGGAGCCUGGAGUGGUCGGGUCGACUGAACCCAGGUUCCCUCUGGCCGCA >hsa-mir-4727 MI0017364 (SEQ ID NO: 2131)
AAUCUGCCAGCUUCCACAGUGGCAGAUUUCCCAUAGUGGGAAGCUGGCAGAUUC >hsa-mir-4728 MI0017365 (SEQ ID NO: 2132)
GUGGGAGGGAGAGGCAGCAAGCACACAGGGCCUGGGACUAGCAUGCUGACCUCCCUCCUGCCCAG >hsa-mir-4729 MI0017366 (SEQ ID NO: 2133)
UCUGUUUCCUCAUUUAUCUGUUGGGAAGCUAACUGUGACCUUAGCGUCCCAGCAGAUAAAUGAGGAAACAGA >hsa-mir-4730 MI0017367 (SEQ ID NO: 2134)
CGCAGGCCUCUGGCGGAGCCCAUUCCAUGCCAGAUGCUGAGCGAUGGCUGGUGUGUGCUGCUCCACAGGCCUGGUG >hsa-mir-4731 MI0017368 (SEQ ID NO: 2135)
CCCUGCCAGUGCUGGGGGCCACAUGAGUGUGCAGUCAUCCACACAAGUGGCCCCCAACACUGGCAGGG >hsa-mir-4732 MI0017369 (SEQ ID NO: 2136)
GAGGGAGCUGUAGAGCAGGGAGCAGGAAGCUGUGUGUGUCCAGCCCUGACCUGUCCUGUUCUGCCCCCAGCCCCUC >hsa-mir-4733 MI0017370 (SEQ ID NO: 2137)
GGUCGCUUAAAUCCCAAUGCUAGACCCGGUGGCAAUCAAGGUCUAGCCACCAGGUCUAGCAUUGGGAUUUAAGCCC >hsa-mir-4734 MI0017371 (SEQ ID NO: 2138)
CUCGGGCCCGACCGCGCCGGCCCGCACCUCCCGGCCCGGAGCUGCGGGCUGCGGUCAGGGCGAUCCCGGG >hsa-mir-4735 MI0017372 (SEQ ID NO: 2139)
UGCAGUGCCUAAUUUGAACACCUUCGGUAUUCAUCAAAAAUACCAAAGGUGCUCAAAUUAGACAUUGCA >hsa-mir-4736 MI0017373 (SEQ ID NO: 2140)
AGGCAGGUUAUCUGGGCUGCCAUCUCCCACUGGCUGCUUGCCUGCCU >hsa-mir-4737 MI0017374 (SEQ ID NO: 2141)
CUGCACAGGAUGCGAGGAUGCUGACAGUGCCUCACAGCCGCACAGGACCGAGGAUGCUGACGGUGCCUCACAGCCAC
ACAG -continued >hsa-mir-4738 MI0017376 (SEQ ID NO: 2142)
GGUCGCAUUUCUCCUUCUUACCAGCGCGUUUUCAGUUUCAUAGGGAAGCCUUUCCAUGAAACUGGAGCGCCUGGAGG
AGAAGGGGCC >hsa-mir-4739 MI0017377 (SEQ ID NO: 2143)
GGGAGGAAGAAGGGAGGAGGAGCGGAGGGGCCCUUGUCUUCCCAGAGCCUCUCCCUUCCUCCCCUCCCCCUCCC >hsa-mir-4740 MI0017378 (SEQ ID NO: 2144)
GCCAAGGACUGAUCCUCUCGGGCAGGGAGUCAGAGGGGACCGCCCGAGAGGAUCCGUCCCUGC >hsa-mir-4741 MI0017379 (SEQ ID NO: 2145)
CGGGCGGGGCGGGUCCGGCCGCCUCCGAGCCCGGCCGGCAGCCCCCGGCCUUAAAGCGCGGGCUGUCCGGAGGGGUC
GGCUUUCCCACCG >hsa-mir-4742 MI0017380 (SEQ ID NO: 2146)
UCAGGCAAAGGGAUAUUUACAGAUACUUUUUAAAAUUUGUUUGAGUUGAGGCAGAUUAAAUAUCUGUAUUCUCCUUU
GCCUGCAG >hsa-mir-4743 MI0017381 (SEQ ID NO: 2147)
GCUGGCCGGAUGGGACAGGAGGCAUGAAUGAGCCAUCUUUCCAAUGCCUUUCUGUCUUUUCUGGUCCAG >hsa-mir-4744 MI0017382 (SEQ ID NO: 2148)
GUAAUCACAUCUAAAGACUAGACUUCGCUAUGACCAGGCCAUAGUAAACAUCAUAGUAUGUCUAGUCUUUAGGUUUG
AUUAC >hsa-mir-4745 MI0017384 (SEQ ID NO: 2149)
GUGAGUGGGCUCCCGGGACGGCGCCCGCCCUGGCCCUGGCCCGGCGACGUCUCACGGUCCC >hsa-mir-4746 MI0017385 (SEQ ID NO: 2150)
GUGUCUGUGCCGGUCCCAGGAGAACCUGCAGAGGCAUCGGGUCAGCGGUGCUCCUGCGGGCCGACACUCAC >hsa-mir-4747 MI0017386 (SEQ ID NO: 2151)
AGGGAAGGAGGCUUGGUCUUAGCACGGGGUCUAAGGCCCGGGCUUUCCUCCCAG >hsa-mir-4748 MI0017387 (SEQ ID NO: 2152)
UGGCUGGCUGAGGUUUGGGGAGGAUUUGCUGGUGCUAGAGAGGAAAGCAGACCCUACCCAACCCCACGCCCUACUAC
AGCCA >hsa-mir-4749 MI0017388 (SEQ ID NO: 2153)
CCUGCGGGGACAGGCCAGGGCAUCUAGGCUGUGCACAGUGACGCCCCUCCUGCCCCCACAG >hsa-mir-4750 MI0017389 (SEQ ID NO: 2154)
CGCUCGGGCGGAGGUGGUUGAGUGCCGACUGGCGCCUGACCCACCCCCUCCCGCAG >hsa-mir-4751 MI0017390 (SEQ ID NO: 2155)
CCCGGAGCCAGAGGACCCGUAGCUGCUAGAAGGGCAGGGGUGUGGCUUCUGGGGGCUGGUCUUCAGCUCUGGCG >hsa-mir-4752 MI0017391 (SEQ ID NO: 2156)
AGUGUCUCCUUGUGGAUCUCAAGGAUGUGCUUCCACAUAGCAGCAUGUUCUUCAGAUGGACAAGGAGACACU >hsa-mir-4753 MI0017392 (SEQ ID NO: 2157)
AUAUCUACACAAGGCCAAAGGAAGAGAACAGAUAUAUCCACAGUACACUUGGCUGUUCUCUUUCUUUAGCCUUGUGU
AGAUAU >hsa-mir-4754 MI0017394 (SEQ ID NO: 2158)
ACGCGCCUGAUGCGGACCUGGGUUAGCGGAGUGAGGCCCAGUGGUCACCGCCGCCCUCCGCAGGUCCAGGUUGCCGU
GCGCAUGUGCCU >hsa-mir-4755 MI0017395 (SEQ ID NO: 2159)
AGAUUCAGCUUUCCCUUCAGAGCCUGGCUUUGGCAUCUAUGAAAGCCAGGCUCUGAAGGGAAAGUUGAAUCU >hsa-mir-4756 MI0017397 (SEQ ID NO: 2160)
GGGAUAAAAUGCAGGGAGGCGCUCACUCUCUGCUGCCGAUUCUGCACCAGAGAUGGUUGCCUUCCUAUAUUUUGUGUC >hsa-mir-4757 MI0017398 (SEQ ID NO: 2161)
UUCCAGCCCGAGGCCUCUGUGACGUCACGGUGUCUGCGGGAGGAGACCAUGACGUCACAGAGGCUUCGCGCUCUGAG >hsa-mir-4758 MI0017399 (SEQ ID NO: 2162)
GGUGAGUGGGAGCCGGUGGGGCUGGAGUAAGGGCACGCCCGGGGCUGCCCCACCUGCUGACCACCCUCCCCC >hsa-mir-4759 MI0017400 (SEQ ID NO: 2163)
CAUUUAGGACUAGAUGUUGGAAUUAGACAGAAAAAAGUUAGACACAAAAAAAUUGUGUCUAAUUCCAACAUCUAGUCC
UAAAUG >hsa-mir-4760 MI0017401 (SEQ ID NO: 2164)
GCCAUGGUGUUUAGAUUGAACAUGAAGUUAGAAUUCUUAAGUAUCAAAACUAAAUUCAUGUUCAAUCUAAACCCCAU
GGC >hsa-mir-4761 MI0017402 (SEQ ID NO: 2165)
GGACAAGGUGUGCAUGCCUGACCCGUUGUCAGACCUGGAAAAAGGGCCGGCUGUGGGCAGGGAGGGCAUGCGCACUU
UGUCC >hsa-mir-4762 MI0017403 (SEQ ID NO: 2166)
CUGAUACCCCAAAUCUUGAUCAGAAGCCUUGAUCAGAAGCUAGGAAGGCUUCUGAUCAAGAUUUGUGGUGUCAAG >hsa-mir-4763 MI0017404 (SEQ ID NO: 2167)
CCUGUCCCUCCUGCCCUGCGCCUGCCCAGCCCUCCUGCUCUGGUGACUGAGGACCGCCAGGCAGGGGCUGGUGCUGG
GCGGGGGGCGGCGGG >hsa-mir-4764 MI0017405 (SEQ ID NO: 2168)
UCUUCCCCAUGGAUGUGGAAGGAGUUAUCUGUCACCAGUCAGAUAACUGUCACCAGUCAGUUAACUCCUUUCACACC
CAUGGGGAAGA >hsa-mir-4765 MI0017406 (SEQ ID NO: 2169)
UGGUGAUUUUGAACGUAGCUAUCCACCACUCAGCCUGGAAAAAGCUGAGUGAUUGAUAGCUAUGUUCAAAAUCACCA >hsa-mir-4766 MI0017407 (SEQ ID NO: 2170)
CUGAAGCUCCUUCUGAAAGAGCAGUUGGUGUUUAUUUUUUACUAAAUAGCAAUUGCUCUUUUGGAAGGAACUUGAG >hsa-mir-4767 MI0017408 (SEQ ID NO: 2171)
ACAUGGGCCCGCGGGCGCUCCUGGCCGCCGCCCGACUUCGGGGCCAGCCGGGGGCAGAGCGCGCGGGAGCCCGAGCGU >hsa-mir-4768 MI0017409 (SEQ ID NO: 2172)
AAACUUUGAUUCUCUCUGGAUCCCAUGGAUAUGGGAACUGUGAUGUCCAGGAGAUCCAGAGAGAAUCAGAGUUU >hsa-mir-4769 MI0017410 (SEQ ID NO: 2173)
GAGGAGAGGUGGGAUGGAGAGAAGGUAUGAGCUAAAAAUCCCCAAGCUCUGCCAUCCUCCCUCCCCUACUUCUCCCC >hsa-mir-4770 MI0017411 (SEQ ID NO: 2174)
GAGUUAUGGGGUCAUCUAUCCUUCCCUUGGAAAAUGAUCUGAGAUGACACUGUAGCUC >hsa-mir-4771-1 MI0017412 (SEQ ID NO: 2175)
GCUCUAGCCUAAUUUUAGAUCUGGUCUGCUUCAGUUUCACUCCAAGCAGACUUGACCUACAAUUAGCCUAGAGC >hsa-mir-4771-2 MI0017413 (SEQ ID NO: 2176)
GCUCUAGCCUAAUUUUAGAUCUGGUCUGCUUCAGUUUCACUCCAAGCAGACUUGACCUACAAUUAGCCUAGAGC >hsa-mir-4772 MI0017414 (SEQ ID NO: 2177)
GUGAUUGCCUCUGAUCAGGCAAAAUUGCAGACUGUCUUCCCAAAUAGCCUGCAACUUUGCCUGAUCAGAGGCAGUCAC >hsa-mir-4773-1 MI0017415 (SEQ ID NO: 2178)
UGCUCCCCAGCCUUUCUAUGCUCCUGUUCUGCUUUAUUUCAUCAAAGCAGAACAGGAGCAUAGAAAGGCUGGGGAGCA >hsa-mir-4773-2 MI0017416 (SEQ ID NO: 2179)
UGCUCCCCAGCCUUUCUAUGCUCCUGUUCUGCUUUGAUGAAAUAAAGCAGAACAGGAGCAUAGAAAGGCUGGGGAGCA >hsa-mir-4774 MI0017417 (SEQ ID NO: 2180)
UAUAUUGUUGUCUGGUAUGUAGUAGGUAAAUAACUGACAAACAGACAAUUGCCUAACAUGUGCCAGAAAACAACAUA >hsa-mir-4775 MI0017418 (SEQ ID NO: 2181)
AUUAAGCUUUUAAUUUUUUGUUUCGGUCACUCUUGAUAGCAGACAUUGACUGAAACAAAAAAUUAAAAGCUUUAU >hsa-mir-4776-1 MI0017419 (SEQ ID NO: 2182)
CUAUAUGCAGUGGACCAGGAUGGCAAGGGCUCUCCUGAAAGGACAGUAGAGCCCUUGCCAUCCUGGUCCACUGCAUA
UAG >hsa-mir-4776-2 MI0017420 (SEQ ID NO: 2183)
CUAUAUGCAGUGGACCAGGAUGGCAAGGGCUCUACUGUCCUUUCAGGAGAGCCCUUGCCAUCCUGGUCCACUGCAUA
UAG >hsa-mir-4777 MI0017421 (SEQ ID NO: 2184)
UAGAAUAUUUCGGCAUUCUAGAUGAGAGAUAUAUAUACCUCAUAUGUAUAUGGUAUACCUCAUCUAGAAUGCUGU
AAUAUUCUA >hsa-mir-4778 MI0017422 (SEQ ID NO: 2185)
UCACAUGUCCAAUUCUGUAAAGGAAGAAGAGGUAAGAAGAAGUGAAGCCCUCUUCUUCCUUUGCAGAGUUGAAUAUG
UGG >hsa-mir-4779 MI0017423 (SEQ ID NO: 2186)
UAAAUGUCUUACUGCUUUUACUGUUCCCUCCUAGAGUCCAUUCUUUACUCUAGGAGGGAAUAGUAAAAGCAGUAAGA
CAUUUA >hsa-mir-4780 MI0017424 (SEQ ID NO: 2187)
GGCCAGUGCCAGGGGGUCAGGCUCAAGGACCAGCCCAAAGGCCAGGCCUGACCCUUGAGCCUGAUCCCUAGCACUGA
UCCC >hsa-mir-4781 MI0017426 (SEQ ID NO: 2188)
AGGUGCACGCUCUAGCGGGGAUUCCAAUAUUGGGCCAAUUCCCCCAAUGUUGGAAUCCUCGCUAGAGCGUGCACUU >hsa-mir-4782 MI0017427 (SEQ ID NO: 2189)
AUUGCCCAGUUCUGGAUAUGAAGACAAUCAAGAAAAGAUUUGGUGUUCUUGAUUGUCUUCAUAUCUAGAACUGGGCAGU >hsa-mir-4783 MI0017428 (SEQ ID NO: 2190)
GGGAAAGCGGAGGGCGCGCCCAGCUCCCGGGCUGAUUGCGCUAACAGUGGCCCCGGUGUUGGGGCGCGUCUGCCGCUGCCCC >hsa-mir-4784 MI0017429 (SEQ ID NO: 2191)
UGACUGGGCUGAGGAGAUGCUGGGACUGAGAGUGUCAUGGUGGAGCCUCCGUCCCUGCUCAUCCUCUCCGCAUGUUG >hsa-mir-4785 MI0017430 (SEQ ID NO: 2192)
GUAGGUGGGACGCGGCGGCGCUGCUCCUCCGCUGCCGCCGGGAGAGUCGGCGACGCCGCCAGCUCCGCGCGC >hsa-mir-4786 MI0017433 (SEQ ID NO: 2193)
GGGCAUGGCCUGAGACCAGGACUGGAUGCACCACUCUCCCUGUGAUGAGGUGAAGCCAGCUCUGGUCUGGGCCAUUUCAC >hsa-mir-4787 MI0017434 (SEQ ID NO: 2194)
CGGUCCAGACGUGGCGGGGUGGCGGCGGCAUCCCGGACGGCCUGUGAGGGAUGCGCCGCCCACUGCCCCGCGCCGCCUGACCG >hsa-mir-4788 MI0017435 (SEQ ID NO: 2195)
AAUGAAGGAUUACGGACCAGCUAAGGGAGGCAUUAGGAUCCUUAUUCUUGCCUCCCUUAGUUGGUCCCUAAUCCUUCGUU >hsa-mir-4789 MI0017436 (SEQ ID NO: 2196)
CAUGCUACGUAUGUAUACACCUGAUAUGUGUAUGUGUAAAUACAUAUCCACACAUAGCAGGUGUAUAUAUAGGUAGCCUG >hsa-mir-4790 MI0017437 (SEQ ID NO: 2197)
CAAUGUGACAUCGCUUUACCAUUCAUGUUCACUGAAAGGUAGAUUUUAAAAACAUGAAUGGUAAAGCGAUGUCACAUUG >hsa-mir-4791 MI0017438 (SEQ ID NO: 2198)
UAAGAACUGGAUAUGAUGACUGAAAUAAGCUCCAUAUCAAUGAGAAUUUCAAUGGGAUUAUGUGCAGUCAAUGUCCAGUAAUUA >hsa-mir-4792 MI0017439 (SEQ ID NO: 2199)
GCAGCCCGGUGAGCGCUCGCUGGCCUGGCAGUGCGUCGGAAGAACAGGGCGGGUGGGGCCGCGCACAUCUCUGC >hsa-mir-4793 MI0017440 (SEQ ID NO: 2200)
UUUCUCCUCGCUGCCCGCACAUCCUGCUCCACAGGGCAGAGGGAGGCCAAGAAGACCUCUGCACUGUGAGUUGGCUGGCUGGAGGAA >hsa-mir-4794 MI0017441 (SEQ ID NO: 2201)
UUUUAACAUCUGGCUAUCUCACGAGACUGUAUGUCCUAACAGUGCUUGUAGUCUCAUGAGAUAGCCAGAUGUUAAAA >hsa-mir-4795 MI0017442 (SEQ ID NO: 2202)
UGAUAUGGAAGAAAUCCAGAAGUGGCUAAUAAUAUUGACACUAUAACAAUAAUGUCAAUAUUAUUAGCCACUUCUGGAUUUAUGAAUCA >hsa-mir-4796 MI0017443 (SEQ ID NO: 2203)
UAAAUUUGUGUCUAUACUCUGUCACUUUACUUUUGGCCUCAAGUCAUUGCAGUAAAGUGGCAGAGUAUAGACACAAAUUUA >hsa-mir-4797 MI0017444 (SEQ ID NO: 2204)
GACUCAGAAGACAGAGUGCCACUUACUGAAAGGUUUUUUCUCUCAGUAAGUGGCACUCUGUCUUCUGAGUU >hsa-mir-4798 MI0017445 (SEQ ID NO: 2205)
AAGUACAACUUCGGUAUACUUUGUGAAUUGGCUUUUACAAAAGACCAACUCACGAAGUAUACCGAAGUCAUACUU >hsa-mir-4799 MI0017446 (SEQ ID NO: 2206)
ACUGCUAAUAUCUAAAUGCAGCAUGCCAGUCCUGAGAUGCAGGGACUGGCAUGCUGCAUUUAUAUAUUAGCAGU >hsa-mir-4800 MI0017448 (SEQ ID NO: 2207)
GGAGAAAGGAGUGGACCGAGGAAGGAAGGAAGGCAAGGCUGUCUGUCCAUCCGUCCGUCUGUCCACCUACCUGUCAGUCC >hsa-mir-4801 MI0017449 (SEQ ID NO: 2208)
UUGAGGCUUGGUUUUCUUAUGUGUAAAAUGUAAUAACAUUUCUUAUGUUUAAAACACUUUACACAAGAAAACCAAGGCUCAA >hsa-mir-4802 MI0017450 (SEQ ID NO: 2209)
CUGACUGGCUUGUAUGGAGGUUCUAGACCAUGUUAGUGUUCAAGUCUACAUGGAUGGAAACCUUCAAGCAGGCCAAG
CAG >hsa-mir-4803 MI0017451 (SEQ ID NO: 2210)
AGUGGGAUUUAACAUAAUAGUGUGGAUUGAAUCACACACACAUUUCAACCCACACUAUGAUGUUAAAUCCCAUU >hsa-mir-4804 MI0017452 (SEQ ID NO: 2211)
UCAGUGUAUUUGGACGGUAAGGUUAAGCAAGGUGCGUCGUAUCUUGCUUAACCUUGCCCUCGAAAUACACUGA >hsa-mir-4999 MI0017865 (SEQ ID NO: 2212)
AUAGAAAAUAAAACACAUACUGCUGUAUUGUCAGGUAGUGAUAGGAUUUAUCACUACCUGACAAUACAGUAUGUGUU
UGUUUUAUAUAUUU >hsa-mir-5000 MI0017866 (SEQ ID NO: 2213)
CUGAAGAGUAGAGUGUGUGGUCCCAGUUCAGAAGUGUUCCUGAGUAACUUGUGCUUAUAACUCAGGACACUUCUGAA
CUUGGACCAUACAGGUCUCCCUGCUU >hsa-mir-5001 MI0017867 (SEQ ID NO: 2214)
AGCUCAGGGCGGCUGCGCAGAGGGCUGGACUCAGCGGCGGAGCUGGCUGCUGGCCUCAGUUCUGCCUCUGUCCAGGU
CCUUGUGACCCGCCCGCUCUCCU >hsa-mir-5002 MI0017868 (SEQ ID NO: 2215)
UCUUCCUCUCUGUCCUCUGGAAUUUGGUUUCUGAGGCACUUAGUAGGUGAUAGCAUGACUGACUGCCUCACUGACCA
CUUCCAGAUGAGGGUUACUC >hsa-mir-5003 MI0017869 (SEQ ID NO: 2216)
AUGAGUUUGCUUUGUGUCAUCCUCACAACAACCUUGCAGGGUAGAGAUGAUUUUUCCUACUUUUCUAGGUUGUUGGG
GGCUGGGGCAGGGGAACAGAG >hsa-mir-5004 MI0017870 (SEQ ID NO: 2217)
GGCACUUGCUUGGGGUUAGUGAGGACAGGGCAAAUUCACGAGAUUGGGUUGUGCAGAGGCUGACACUUGGAUUUUC
CUGGGCCUCAGGACUUCCUUUCAGACAUGG >hsa-mir-5006 MI0017873 (SEQ ID NO: 2218)
AACCAUUAGGGGGCUGUGGUUUGCCAGGGCAGGAGGUGGAAGGGAGCCCCAUUUACAGUGGUAACUUCCUUUCCCUU
UCCAUCCUGGCAGGCUUCAGAGAACUUUACCAG >hsa-mir-5007 MI0017874 (SEQ ID NO: 2219)
GGUAAACCUUGGUGACUAAUUAGAGUCUGGCUGAUAUGGUUUGACACAGAGCUAAAUCAUAUGAACCAAACUCUAAU
UAGUCAAUAAUUUCUGUU >hsa-mir-5008 MI0017876 (SEQ ID NO: 2220)
GGGCUGACCCCUAGGGUCAGGUGAGGCCCUUGGGGCACAGUGGUGCCAUCUCCCCUGUGCUCCCAGGGCCUCGCCUG
UCCCUUGAGGUCGGCCC >hsa-mir-5009 MI0017877 (SEQ ID NO: 2221)
GACCAGAAGUGUUUUGGAUUUGGACUUUUUCAGAUUUGGGGAUAUUUGCAUUAUACUUAUCCUAAAUCUGAAAGUC
CAAAACCUGAAAUGACCAAUAAG >hsa-mir-5010 MI0017878 (SEQ ID NO: 2222)
GAUCCAGGGAACCCUAGAGCAGGGGGAUGGCAGAGCAAAAUUCAUGGCCUACAGCUGCCUCUUGCCAAACUGCACUG
GAUUUUGUGUCUCCCAUUCCCCAGAGCUGUCUGAGGUGCUUUG >hsa-mir-5011 MI0017879 (SEQ ID NO: 2223)
AGAUGGUAUUGAGUGGAUGCUGUUAUAUAUACAGCCAUGCACUCUGUAGUUUGGGUACACAGUGCAUGGCUGUAUAU
AUAACACUAUCCAUUCAUCUUUCAGC >hsa-mir-5047 MI0017932 (SEQ ID NO: 2224)
GAAGCGCUUGCCUAGACGAGACACAGUGCAUAAAAACAACUUUUGGGGGACAGGUAUGUUUUCUUGCAGCUGCGGUU
GUAAGGUCUUGGCAAGACAAGCA >hsa-mir-5087 MI0017976 (SEQ ID NO: 2225)
AGCUUUCUACGGGUUUGUAGCUUUGCUGGCAUGUUAAGUGUUGUCCUACAGUCGCAAGCAUAAGAAAGAGAAAGUA >hsa-mir-5088 MI0017977 (SEQ ID NO: 2226)
UCUCCAGGGUGGCCAGGCGGGGCCGGGCCUGAGGGAUGGAGGGGAGCCCAUCAGGGCUCAGGGAUUGGAUGGAGGUG
AUGGGGG >hsa-mir-5089 MI0017978 (SEQ ID NO: 2227)
AAGGACUUCAGUGGGAUUUCUGAGUAGCAUCCUUGGAAUCUGCACUCAAGGGAUGCUACUCGGAAAUCCCACUGAAG
UCCUUUU >hsa-mir-5090 MI0017979 (SEQ ID NO: 2228)
UCUGAGGUACCCGGGGCAGAUUGGUGUAGGGUGCAAAGCCUGCCCGCCCCCUAAGCCUUCUGCCCCCAACUCCAGCC
UGUCAGGA -continued >hsa-mir-5091 MI0017980 (SEQ ID NO: 2229)
GACUGUGGCGACGGAGACGACAAGACUGUGCUGGUCGCGGGUUGUGGGGUUUAGGUCACCGGCAGGGGUCUGGAGUC
CCUGGAGGUUAGGGCU >hsa-mir-5092 MI0017981 (SEQ ID NO: 2230)
AUCCCAGAUCAGAUGCCAAAGCCAGUGGGGACUGGACAACAUGAUGAGCCCAAACCAAUCCACGCUGAGCUUGGCAU
CUGAUUUGGGA >hsa-mir-5093 MI0017982 (SEQ ID NO: 2231)
CCCGCCAGGUCCACAUGCCAGAGUGUCAACGUGACCCAGCCAGCCUCCUUCCUGAGCUAGGAGGAUUAGGAAAUGAG
GCUGGCUAGGAGCACAGCCAGGG >hsa-mir-5094 MI0017983 (SEQ ID NO: 2232)
AAAAGAAAAAAAUCAGUGAAUGCCUUGAACCUAACACACUGCCUUUUAUGUGGUAGGUACAGUGGGCUCACUGAAAC
AUUCAACU >hsa-mir-5095 MI0018001 (SEQ ID NO: 2233)
CUGGGAUUACAGGCGUGAACCACCGCGCCCGGCCUAACUUUUAAGAAACGUCGGCCCGGGAGCGGUGGCUCACGCCU
GUAAUCCCAGC >hsa-mir-5096 MI0018004 (SEQ ID NO: 2234)
AGUAGAGGUGGGGUUUCACCAUGUUGGUCAGGCUGGUCUCAAACUCCUGACCUCAGGUGAUCCAUCCACC >hsa-mir-5100 MI0019116 (SEQ ID NO: 2235)
CCAUGAGGAGCUGGCAGUGGGAUGGCCUGGGGGUAGGAGCGUGGCUUCUGGAGCUAGACCACAUGGGUUCAGAUCCC
AGCGGUGCCUCUAACUGGCCACAGGACCUUGGGCAGUCAGCU >hsa-mir-5186 MI0018165 (SEQ ID NO: 2236)
UCAGCCAGCUUAUGACUUGACCCUCUCACCUGAUUUCUACCAACCUUUCCUCAGCUGAUUUCUUUCUGGGGAGAGAU
UGGUAGAAAUCAGGUGAGAGGGUCAUGCCAUAAGCUGGCUAAC >hsa-mir-5187 MI0018166 (SEQ ID NO: 2237)
GACUAAGGGUGGGAUGAGGGAUUGAAGUGGAGCAGGAAUGCGCUUUUCUCCACUGAAUCCUCUUUUCCUCAGGUGG >hsa-mir-5188 MI0018167 (SEQ ID NO: 2238)
GGGAGGCAUGGAAAUUUCUCUGGUUUCAAUGGGUACGAUUAUUGUAAGCAGGAUCCAUUCAAUAAUCGGACCCAUUU
AAACCGGAGAUUUUAAAAGACAGGAAUAGAAUCCCA >hsa-mir-5189 MI0018168 (SEQ ID NO: 2239)
GGCCCGCCUUUUAGGGGCCUCGCUGUCUGGGCACAGGCGGAUGGACAGGCUGGCCUCUGGAUGACCUGCCAACCGUC
AGAGCCCAGACCCACGUGGCCUCAGUUGGGGACCAGG >hsa-mir-5190 MI0018169 (SEQ ID NO: 2240)
GGUCAUACCCUGGCUCCAGCCCUGUCACAUGGUUAAUGUUCCACAGCCAGUGACUGAGCUGGAGCCAGGGCCACUGC
CCC >hsa-mir-5191 MI0018170 (SEQ ID NO: 2241)
AGUUGGCCAGGACCCCAAGCCCCCAGCACUUCAUUCUUGCUGUCCUCUCCGGUCUGGGAGGAUAGAAGAGAGGAUA
GGAAGAAUGAAGUGCUGGGCGCUUAGGGGGAUCCUGGCCAACU >hsa-mir-5192 MI0018171 (SEQ ID NO: 2242)
UUAGUUCCAGCCUCCUGGCUCACCUGGAACCAUUUCUCCUGGGAAGCAUGGUAGCCAGGAGAGUGGAUUCCAGGUGG
UGAGGGCUUGGUACU >hsa-mir-5193 MI0018172 (SEQ ID NO: 2243)
CCUAGGAAAGGCUGCUGGUAACUGGGAUGGGGGUUGGGGGAGGUAAGAAGUCUCUGACUCCUCCUCUACCUCAUCC
CAGUUCCAUCACCUGAAGUGGACCUCUUGGGA >hsa-mir-5194 MI0018173 (SEQ ID NO: 2244)
AUUUCUUUGGGUUAACUUAAACUCAGCCCUUCUAGGCCCAUUCUUUUCACUCAGGAAUUGGAUAAGCUUUUCUGAGG
GGUUUGGAAUGGGAUGGCAGGGAGAGUCACCAGACACCAUGAA >hsa-mir-5195 MI0018174 (SEQ ID NO: 2245)
GAGCAAAACCAGAGAACAACAUGGGAGCGUUCCUAACCCCUAAGGCAACUGGAUGGGAGACCUGACCCAUCCAGUU
CUCUGAGGGGGCUCUUGUGUGUUCUACAAGGUUGUUCA >hsa-mir-5196 MI0018175 (SEQ ID NO: 2246)
UCUGAGGAGACCUGGGCUGUCAGAGGCCAGGGAAGGGGACGAGGGUUGGGGAACAGGUGGUUAGCACUUCAUCCUCG
UCUCCCUCCCAGGUUAGAAGGGCCCCCCUCUCUGAAGG >hsa-mir-5197 MI0018176 (SEQ ID NO: 2247)
UAUGGGAUUCCACAGACAAUGAGUAUCAAUGGCACAAACUCAUUCUUGAAUUUUUGCCAGUUCAAGAAGAGACUGAG
UCAUCGAAUGCUCUAAAUGUCACUUCACCUCAUGU >hsa-mir-5571 MI0019115 (SEQ ID NO: 2248)
AUCUGACACAAAAUGUGAACCAAGCAAUUCUCAAAGGAGCCUCCCAGGAAAUUCACUUUAGGAAGUCCUAGGAGGCU
CCUCUGAGAGUUGCUAAAACAAAACAUUGAGAGUCC >hsa-mir-5572 MI0019117 (SEQ ID NO: 2249)
AGCCAGACAAGAGGGUCAUGGGGAGUCACUGUCAACCCAGAGCAGGCACUGCCCCUGCGACCAGCCUGGGGCAUCGG
UUGGGGUGCAGGGGUCUGCUGGUGAUGCUUUCCAUCUCUUUGCUUUGUCCUGAUUGUAGC >hsa-mir-5579 MI0019133 (SEQ ID NO: 2250)
UAUGGUACUCCUUAAGCUAACAGGCCCCUGUCACCAUUAGCUUAAGGAGUACCAGAUC >hsa-mir-5580 MI0019135 (SEQ ID NO: 2251)
UGCUGGCUCAUUUCAUAUGUGUGCUGAGAAAAUUCACACAUAUGAAGUGAGCCAGCAC >hsa-mir-5581 MI0019136 (SEQ ID NO: 2252)
AGCCUUCCAGGAGAAAUGGAGACCCUAUACAUACCUGUUUCCAUGCCUCCUAGAAGUUCC >hsa-mir-5582 MI0019138 (SEQ ID NO: 2253)
UAGGCACACUUAAAGUUAUAGCUACAUCAGUUAUAACUAUAUCAGUUAAAACUUUAAGUGUGCCUAGG >hsa-mir-5583-1 MI0019139 (SEQ ID NO: 2254)
AAACUAAUAUACCCAUAUUCUGGCUAGGUGAUCAUCAGAAUAUGGGUAUAUUAGUUUGG >hsa-mir-5583-2 MI0019140 (SEQ ID NO: 2255)
AAACUAAUAUACCCAUAUUCUGAUGAUCACCUAGCCAGAAUAUGGGUAUAUUAGUUUGG >hsa-mir-5584 MI0019141 (SEQ ID NO: 2256)
CAGGGAAAUGGGAAGAACUAGAUUUGAAUCCAGACCUUUAGUUCUUCCCUUUGCCCAAUU >hsa-mir-5585 MI0019142 (SEQ ID NO: 2257)
UGAAGUACCAGCUACUCGAGAGGUCAGAGGAUUGCUCCUGAAUAGCUGGGACUACAGGU >hsa-mir-5586 MI0019143 (SEQ ID NO: 2258)
UAUCCAGCUUGUUACUAUAUGCUUUUUAAAUGGGGCACAGAGUGACAAGCUGGUUAAAG >hsa-mir-5587 MI0019144 (SEQ ID NO: 2259)
AUGGUCACCUCCGGGACUCAGCCCUGUGCUGAGCCCCGGGCAGUGUGAUCAUC >hsa-mir-5588 MI0019147 (SEQ ID NO: 2260)
ACUGGCAUUAGUGGGACUUUUUUUUUUUUUUUUAAUGUUAAAAGUCCCACUAAUGCCAGC >hsa-mir-5589 MI0019148 (SEQ ID NO: 2261)
GGCUGGGUGCUCUUGUGCAGUGAGCAACCUACACAACUGCACAUGGCAACCUAGCUCCCA >hsa-mir-5590 MI0019150 (SEQ ID NO: 2262)
UUGCCAUACAUAGACUUUAUUGUGUUGAUCAACAAUAAAGUUCAUGUAUGGCAA >hsa-mir-5591 MI0019151 (SEQ ID NO: 2263)
UGGGAGCUAAGCUAUGGGUAUACUGAGCUUAUGUAUGCAUCUGCAUACCCAUAGCUUAGCUCCCA >hsa-mir-5680 MI0019280 (SEQ ID NO: 2264)
GCAUUGGGUUAGCAGGUUAGCCCAGCAUUUCCCUUCCUGGACACACAGGAGGAGAAAUGCUGGACUAAUCUGCUAAU
CCAAUGC >hsa-mir-5681a MI0019281 (SEQ ID NO: 2265)
AGUUUUUGAAGAGUAUUGCCACCCUUUCUAGUCCCUAUUAGACUAGAAAGGGUGGCAAUACCUCUUCCAAAAACU >hsa-mir-5681b MI0019293 (SEQ ID NO: 2266)
GAAGAGGUAUUGCCACCCUUUCUAGUCUAAUAGGGACUAGAAAGGGUGGCAAUACUCUUC >hsa-mir-5682 MI0019282 (SEQ ID NO: 2267)
GGCCCAUGGGUCUUAUCCUGCAAGGUGCUGCAGAGACGAGGCCUGUAGCACCUUGCAGGAUAAGGUCUACUGGGCC >hsa-mir-5683 MI0019284 (SEQ ID NO: 2268)
GGAGCUUGUUACAGAUGCAGAUUCUCUGACUUCUUACUGCACCAGUGAAGUCAGGAUCUGCAUUUGAAUAAGACCC >hsa-mir-5684 MI0019285 (SEQ ID NO: 2269)
GCUGAACUCUAGCCUGAGCAACAGAGUGAGAUGGUCUUGUUUUGUUGCCCAGGCUGGAGUCCAGU >hsa-mir-5685 MI0019287 (SEQ ID NO: 2270)
CUCUACAUCACAGCCCAGCAGUUAUCACGGGCCCCUCCCCUCAAUGGGCCCGUGAUAACUGCAGGGCUGUGAUGUAG
AG >hsa-mir-5686 MI0019290 (SEQ ID NO: 2271)
UAUCGUAUCGUAUCGUAUCGUAUUGUAUUGUACUGUAUUGUAUUGUACUGUAUUGUAUCGUAUCGUAUCGUAUCGUA
UCGUA >hsa-mir-5687 MI0019291 (SEQ ID NO: 2272)
CCUCACUUAUCUGACUCUGAAAUCUUCUAAAUGGUACCCACUUUAUUUAGAACGUUUUAGGGUCAAAUAAGUACAGG -continued >hsa-mir-5688 MI0019292 (SEQ ID NO: 2273)
GAAACACUUUGCCUUUUUACAGGAGUUUAUUAUGUUUUGGACAUAGAAACAUAACAAACACCUGUAAAACAGCAAAG
UGUUUC >hsa-mir-5689 MI0019294 (SEQ ID NO: 2274)
AGCGUGGUAGCAUACACCUGUAGUCCUAGAUACUCAGGAGGGUGAGUAUCUAGGACUACAGGUGUGUGCUACCACGCU >hsa-mir-5690 MI0019295 (SEQ ID NO: 2275)
CUUUUAAUUUCAGCUACUACCUCUAUUAGGAUUUGGGAGUUAUACUAAUAGAGGUAAUAGUUGAAAUUAAGAG >hsa-mir-5691 MI0019296 (SEQ ID NO: 2276)
GGACAAGCUUGCUCUGAGCUCCGAGAAAGCUGACAGACAGCUGCUUGGUGUUCAGAGCUUGUCUGUCC >hsa-mir-5692a-1 MI0019297 (SEQ ID NO: 2277)
GACAGUACAAAUAAUACCACAGUGGGUGUACCUCAUGUGUGUACACCCUGUGAUAUUAUUUGUAAUAUC >hsa-mir-5692a-2 MI0019298 (SEQ ID NO: 2278)
UACAAAUAAUACCACAGUGGGUGUACCUCAUGUGUGUACACCCUGUGAUAUUAUUUGUA >hsa-mir-5692b MI0019311 (SEQ ID NO: 2279)
GAUAUUAUGAAUAAUAUCACAGUAGGUGUUCACACAUAAUGUGUACACCAUGUGUGUACACCCAUGUGAUAUUUGAA
GUAGUAUGUC >hsa-mir-5692c-1 MI0019288 (SEQ ID NO: 2280)
UAUAACAUUGUAUAUACCCACUGUGAUAUUAAGAGUAAUAGCUCUCUAGGUUAUUAUGAAUAAUAUCACAGUAGGUG
UACACAAUGUUGUA >hsa-mir-5692c-2 MI0019289 (SEQ ID NO: 2281)
UGUGUACACCAACUGUGAUAUUAGGAGUCCUAUUUAUUUUUAGGAUAUUAGGAAUAAUAUCACAGUAGGUGUACACA >hsa-mir-5693 MI0019300 (SEQ ID NO: 2282)
CUGGGAAGUUAGUUCAUUUCAGUCUGUGCUGUGAGCUAGCCAGCAGUGGCUCUGAAAUGAACUCAAACUCUAG >hsa-mir-5694 MI0019301 (SEQ ID NO: 2283)
GCCAACUGCAGAUCAUGGGACUGUCUCAGCCCCAUAUGUAUCUGAAGGCUGAGAAGUCCCAUGAUCCGCACUUGGC >hsa-mir-5695 MI0019302 (SEQ ID NO: 2284)
CAAGGCCUAUCUAUCUAGAUUCUUCUUGGCCUCUCUGAGCAUGCAUUCCUGAGACUCCAAGAAGAAUCUAGACAGAU
AGGCCUUG >hsa-mir-5696 MI0019303 (SEQ ID NO: 2285)
GUGCUCAUUUAAGUAGUCUGAUGCCUACUACUGAUGACAUACAAUGUAAGUGCUCAUUUAGGCGUCAGACUACCUAA
AUGAGCAC >hsa-mir-5697 MI0019304 (SEQ ID NO: 2286)
AGCAUAUUCUCAAGUAGUUUCAUGAUAAAGGGUGUAUGAGAGAUCAACCCUUUAUCAUGAAACGCUUGAGGAUACGCU >hsa-mir-5698 MI0019305 (SEQ ID NO: 2287)
CUGUGCACCUGGGGGAGUGCAGUGAUUGUGGAAUGCAAAGUCCCACAAUCACUGUACUCCCCAGGUGCACAG >hsa-mir-5699 MI0019306 (SEQ ID NO: 2288)
CUGUACCCCUGCCCCAACAAGGAAGGACAAGAGGUGUGAGCCACACACACGCCUGGCCUCCUGUCUUUCCUUGUUGG
AGCAGGGAUGUAG >hsa-mir-5700 MI0019307 (SEQ ID NO: 2289)
UUAAUUAAUGCAUUAAAUUAUUGAAGGCCCUUGGGCACCCCAGGCCUUCAAUAAUUUAAUGCAUUUAUUGA >hsa-mir-5701-1 MI0019308 (SEQ ID NO: 2290)
GAUUGGACUUUAUUGUCACGUUCUGAUUGGUUAGCCUAAGACUUGUUCUGAUCCAAUCAGAACAUGAAAAUAACGUC
CAAUC >hsa-mir-5701-2 MI0019593 (SEQ ID NO: 2291)
GAUUGGACUUUAUUGUCACGUUCUGAUUGGUUAGCCUAAGACUUGUUCUGAUCCAAUCAGAACAUGAAAAUAACGUC
CAAUC >hsa-mir-5702 MI0019309 (SEQ ID NO: 2292)
GCCUCAACUCCUGGGAUAUGUUGCUGAUCCAACCUGAAAUCCUUCUGUAGGUUGAGUCAGCAACAUAUCCCAUGACU
UUUGGGU >hsa-mir-5703 MI0019310 (SEQ ID NO: 2293)
UUGCCGUCCCCUUCCUCGUCUUUUCCCCUCAGGAGAAGUCGGGAAGGUGGCGGCGG >hsa-mir-5704 MI0019312 (SEQ ID NO: 2294)
UGAUCUUGUUUAGGCCAUCAUCCCAUUAUGCUAAGUCCAUGGGCAAACAUAACAGGAUGAUGGCCUAAACAAGACCA >hsa-mir-5705 MI0019313 (SEQ ID NO: 2295)
UCCCCAUUUACACAGGCCAUGAGCCCCGAAACACCCAUCCCAGGAUUGCUGAUGGGGUGUUUCGGGGCUCAUGGCCUG
UGUAAAUGGGGA -continued >hsa-mir-5706 MI0019314 (SEQ ID NO: 2296)
AGCUAGGUCUUCUGGAUAACAUGCUGAAGCUUCUACGUCAUUCAGCACUUGCUUCAGCAUGUUUUCCAGAGGAUCUA
GCU >hsa-mir-5707 MI0019315 (SEQ ID NO: 2297)
UGUAAGAACACGUUUGAAUGCUGUACAAGGCACAUAUGUGAACAUUGUACCACAUGUACAGCUUUCAAACAUGCUCU
UAUA >hsa-mir-5708 MI0019316 (SEQ ID NO: 2298)
AUUACAGACAUGAGCGACUGUGCCUGACCAAAAGUCAACAUUAAACAACAAAUCUUGGCCAGGCACAGUGGCUCAUG
CCUGUAAU

SEQUENCE LISTING (2308 sequences)

SEQ ID NO: 1 - DNA, 15 bp, Artificial Sequence
  Description of Artificial Sequence: Synthetic oligonucleotide
gctagacgttagcgt

SEQ ID NO: 2 - DNA, 15 bp, Artificial Sequence
  Description of Artificial Sequence: Synthetic oligonucleotide
gctagatgttagcgt

SEQ ID NO: 3 - DNA, 15 bp, Artificial Sequence
  Description of Artificial Sequence: Synthetic oligonucleotide
gctagacgttagcgt

SEQ ID NO: 4 - DNA, 15 bp, Artificial Sequence
  Description of Artificial Sequence: Synthetic oligonucleotide
gctagacgttagcgt

SEQ ID NO: 5 - DNA, 15 bp, Artificial Sequence
  Description of Artificial Sequence: Synthetic oligonucleotide
gcatgacgttgagct

SEQ ID NO: 6 - DNA, 20 bp, Artificial Sequence
  Description of Artificial Sequence: Synthetic oligonucleotide
atggaaggtccagcgttctc

SEQ ID NO: 7 - DNA, 20 bp, Artificial Sequence
  Description of Artificial Sequence: Synthetic oligonucleotide
atcgactctcgagcgttctc

SEQ ID NO: 8 - DNA, 20 bp, Artificial Sequence
  Description of Artificial Sequence: Synthetic oligonucleotide
atcgactctcgagcgttctc

SEQ ID NO: 9 - DNA, 20 bp, Artificial Sequence
  Description of Artificial Sequence: Synthetic oligonucleotide
atcgactctcgagcgttctc

SEQ ID NO: 10 - DNA, 20 bp, Artificial Sequence
  Description of Artificial Sequence: Synthetic oligonucleotide
atcgactctcgagcgttctc

SEQ ID NO: 11 - DNA, 20 bp, Artificial Sequence
  Description of Artificial Sequence: Synthetic oligonucleotide
atcgactctcgaacgttctc

SEQ ID NO: 12 - DNA, 20 bp, Artificial Sequence
  Description of Artificial Sequence: Synthetic oligonucleotide
gagaacgctggaccttccat

SEQ ID NO: 13 - DNA, 20 bp, Artificial Sequence
  Description of Artificial Sequence: Synthetic oligonucleotide
gagaacgctcgaccttccat

SEQ ID NO: 14 - DNA, 20 bp, Artificial Sequence
  Description of Artificial Sequence: Synthetic oligonucleotide
gagaacgctcgaccttcgat

SEQ ID NO: 15 - DNA, 20 bp, Artificial Sequence
  Description of Artificial Sequence: Synthetic oligonucleotide
gagcaagctggaccttccat

SEQ ID NO: 16 - DNA, 20 bp, Artificial Sequence
  Description of Artificial Sequence: Synthetic oligonucleotide
gagcacgctggaccttccat

SEQ ID NO: 17 - DNA, 20 bp, Artificial Sequence
  Description of Artificial Sequence: Synthetic oligonucleotide
gagaacgctggaccttccat

SEQ ID NO: 18 - DNA, 20 bp, Artificial Sequence
  Description of Artificial Sequence: Synthetic oligonucleotide
gagaacgatggaccttccat

SEQ ID NO: 19 - DNA, 20 bp, Artificial Sequence
  Description of Artificial Sequence: Synthetic oligonucleotide
gagaacgctccagcactgat

SEQ ID NO: 20 - DNA, 19 bp, Artificial Sequence
  Description of Artificial Sequence: Synthetic oligonucleotide
ccatgtcggtcctgatgct

SEQ ID NO: 21 - DNA, 20 bp, Artificial Sequence
  Description of Artificial Sequence: Synthetic oligonucleotide
tccatgctggtcctgatgct

SEQ ID NO: 22 - DNA, 20 bp, Artificial Sequence
  Description of Artificial Sequence: Synthetic oligonucleotide
tccatgtcggtcctgatgct

SEQ ID NO: 23 - DNA, 20 bp, Artificial Sequence
  Description of Artificial Sequence: Synthetic oligonucleotide
tccatgtcggtcctgatgct

SEQ ID NO: 24 - DNA, 20 bp, Artificial Sequence
  Description of Artificial Sequence: Synthetic oligonucleotide
tccatgacgttcctgatgct

SEQ ID NO: 25 - DNA, 20 bp, Artificial Sequence
  Description of Artificial Sequence: Synthetic oligonucleotide
tccatgtcggtcctgacgca

SEQ ID NO: 26 - DNA, 8 bp, Artificial Sequence
  Description of Artificial Sequence: Synthetic oligonucleotide
tcaacgtt

SEQ ID NO: 27 - DNA, 8 bp, Artificial Sequence
  Description of Artificial Sequence: Synthetic oligonucleotide
tcaagctt

SEQ ID NO: 28 - DNA, 8 bp, Artificial Sequence
  Description of Artificial Sequence: Synthetic oligonucleotide
tcagcgct

SEQ ID NO: 29 - DNA, 8 bp, Artificial Sequence
  Description of Artificial Sequence: Synthetic oligonucleotide
tcttcgat

SEQ ID NO: 30 - DNA, 8 bp, Artificial Sequence
  Description of Artificial Sequence: Synthetic oligonucleotide
tcttcgaa

SEQ ID NO: 31 - DNA, 7 bp, Artificial Sequence
  Description of Artificial Sequence: Synthetic oligonucleotide
caacgtt

SEQ ID NO: 32 - DNA, 8 bp, Artificial Sequence
  Description of Artificial Sequence: Synthetic oligonucleotide
ccaacgtt

SEQ ID NO: 33 - DNA, 9 bp, Artificial Sequence
  Description of Artificial Sequence: Synthetic oligonucleotide
caacgttct

SEQ ID NO: 34 - DNA, 8 bp, Artificial Sequence
  Description of Artificial Sequence: Synthetic oligonucleotide
tcaacgtc

SEQ ID NO: 35 - DNA, 20 bp, Artificial Sequence
  Description of Artificial Sequence: Synthetic oligonucleotide
atggactctccagcgttctc

SEQ ID NO: 36 - DNA, 20 bp, Artificial Sequence
  Description of Artificial Sequence: Synthetic oligonucleotide
ataggaggtccaacgttctc

SEQ ID NO: 37 - DNA, 20 bp, Artificial Sequence
  Description of Artificial Sequence: Synthetic oligonucleotide
atcgactctcgagcgttctc

SEQ ID NO: 38 - DNA, 20 bp, Artificial Sequence
  Description of Artificial Sequence: Synthetic oligonucleotide
atggaggctccatcgttctc

SEQ ID NO: 39 - DNA, 21 bp, Artificial Sequence
  Description of Artificial Sequence: Synthetic oligonucleotide
atcggactctcgagcgttctc

SEQ ID NO: 40 - DNA, 20 bp, Artificial Sequence
  Description of Artificial Sequence: Synthetic oligonucleotide
atcgactctcgagcgttctc

SEQ ID NO: 41 - DNA, 15 bp, Artificial Sequence
  Description of Artificial Sequence: Synthetic oligonucleotide
gcatgacgttgagct

SEQ ID NO: 42 - DNA, 20 bp, Artificial Sequence
  Description of Artificial Sequence: Synthetic oligonucleotide
tccatgtcggtcctgatgct

SEQ ID NO: 43 - DNA, 20 bp, Artificial Sequence
  Description of Artificial Sequence: Synthetic oligonucleotide
tccatgccggtcctgatgct

SEQ ID NO: 44 - DNA, 20 bp, Artificial Sequence
  Description of Artificial Sequence: Synthetic oligonucleotide
tccatggcggtcctgatgct

SEQ ID NO: 45 - DNA, 20 bp, Artificial Sequence
  Description of Artificial Sequence: Synthetic oligonucleotide
tccatgacggtcctgatgct

SEQ ID NO: 46 - DNA, 20 bp, Artificial Sequence
  Description of Artificial Sequence: Synthetic oligonucleotide
tccatgtcgatcctgatgct

SEQ ID NO: 47 - DNA, 20 bp, Artificial Sequence
  Description of Artificial Sequence: Synthetic oligonucleotide
tccatgtcgctcctgatgct

SEQ ID NO: 48 - DNA, 20 bp, Artificial Sequence
  Description of Artificial Sequence: Synthetic oligonucleotide
tccatgtcgttcctgatgct

SEQ ID NO: 49 - DNA, 20 bp, Artificial Sequence
  Description of Artificial Sequence: Synthetic oligonucleotide
tccataacgttcctgatgct

SEQ ID NO: 50 - DNA, 20 bp, Artificial Sequence
  Description of Artificial Sequence: Synthetic oligonucleotide
tccatgacgtccctgatgct

SEQ ID NO: 51 - DNA, 20 bp, Artificial Sequence
  Description of Artificial Sequence: Synthetic oligonucleotide
tccatcacgtgcctgatgct

SEQ ID NO: 52 - DNA, 19 bp, Artificial Sequence
  Description of Artificial Sequence: Synthetic oligonucleotide
ggggtcaacgttgacgggg

SEQ ID NO: 53 - DNA, 19 bp, Artificial Sequence
  Description of Artificial Sequence: Synthetic oligonucleotide
ggggtcagtcgtgacgggg

SEQ ID NO: 54 - DNA, 15 bp, Artificial Sequence
  Description of Artificial Sequence: Synthetic oligonucleotide
gctagacgttagtgt

SEQ ID NO: 55 - DNA, 15 bp, Artificial Sequence
  Description of Artificial Sequence: Synthetic oligonucleotide
gctagacgttagtgt

SEQ ID NO: 56 - DNA, 20 bp, Artificial Sequence
  Description of Artificial Sequence: Synthetic oligonucleotide
tccatgtcgttcctgatgct

SEQ ID NO: 57 - DNA, 20 bp, Artificial Sequence
  Description of Artificial Sequence: Synthetic oligonucleotide
tccatgtcgttcctgatgct

SEQ ID NO: 58 - DNA, 24 bp, Artificial Sequence
  Description of Artificial Sequence: Synthetic oligonucleotide
accatggacgatctgtttcccctc

SEQ ID NO: 59 - DNA, 18 bp, Artificial Sequence
  Description of Artificial Sequence: Synthetic oligonucleotide
tctcccagcgtgcgccat

SEQ ID NO: 60 - DNA, 18 bp, Artificial Sequence
  Description of Artificial Sequence: Synthetic oligonucleotide
taccgcgtgcgaccctct

SEQ ID NO: 61 - DNA, 24 bp, Artificial Sequence
  Description of Artificial Sequence: Synthetic oligonucleotide
accatggacgaactgtttcccctc

SEQ ID NO: 62 - DNA, 24 bp, Artificial Sequence
  Description of Artificial Sequence: Synthetic oligonucleotide
accatggacgagctgtttcccctc

SEQ ID NO: 63 - DNA, 24 bp, Artificial Sequence
  Description of Artificial Sequence: Synthetic oligonucleotide
accatggacgacctgtttcccctc

SEQ ID NO: 64 - DNA, 24 bp, Artificial Sequence
  Description of Artificial Sequence: Synthetic oligonucleotide
accatggacgtactgtttcccctc

SEQ ID NO: 65 - DNA, 24 bp, Artificial Sequence
  Description of Artificial Sequence: Synthetic oligonucleotide
accatggacggtctgtttcccctc

SEQ ID NO: 66 - DNA, 24 bp, Artificial Sequence
  Description of Artificial Sequence: Synthetic oligonucleotide
accatggacgttctgtttcccctc

SEQ ID NO: 67 - DNA, 15 bp, Artificial Sequence
  Description of Artificial Sequence: Synthetic oligonucleotide
cacgttgaggggcat

SEQ ID NO: 68 - DNA, 15 bp, Artificial Sequence
  Description of Artificial Sequence: Synthetic oligonucleotide
ctgctgagactggag

SEQ ID NO: 69 - DNA, 12 bp, Artificial Sequence
  Description of Artificial Sequence: Synthetic oligonucleotide
tcagcgtgcgcc

SEQ ID NO: 70 - DNA, 17 bp, Artificial Sequence
  Description of Artificial Sequence: Synthetic oligonucleotide
atgacgttcctgacgtt

SEQ ID NO: 71 - DNA, 17 bp, Artificial Sequence
  Description of Artificial Sequence: Synthetic oligonucleotide
tctcccagcgggcgcat

SEQ ID NO: 72 - DNA, 18 bp, Artificial Sequence
  Description of Artificial Sequence: Synthetic oligonucleotide
tctcccagcgcgcgccat

SEQ ID NO: 73 - DNA, 20 bp, Artificial Sequence
  Description of Artificial Sequence: Synthetic oligonucleotide
tccatgtcgttcctgtcgtt

SEQ ID NO: 74 - DNA, 20 bp, Artificial Sequence
  Description of Artificial Sequence: Synthetic oligonucleotide
tccatagcgttcctagcgtt

SEQ ID NO: 75 - DNA, 21 bp, Artificial Sequence
  Description of Artificial Sequence: Synthetic oligonucleotide
tcgtcgctgtctccgcttctt

SEQ ID NO: 76 - DNA, 19 bp, Artificial Sequence
  Description of Artificial Sequence: Synthetic oligonucleotide
tcctgacgttcctgacgtt

SEQ ID NO: 77 - DNA, 19 bp, Artificial Sequence
  Description of Artificial Sequence: Synthetic oligonucleotide
tcctgtcgttcctgtcgtt

SEQ ID NO: 78 - DNA, 20 bp, Artificial Sequence
  Description of Artificial Sequence: Synthetic oligonucleotide
tccatgtcgtttttgtcgtt

SEQ ID NO: 79 - DNA, 20 bp, Artificial Sequence
  Description of Artificial Sequence: Synthetic oligonucleotide
tcctgtcgttccttgtcgtt

SEQ ID NO: 80 - DNA, 20 bp, Artificial Sequence
  Description of Artificial Sequence: Synthetic oligonucleotide
tccttgtcgttcctgtcgtt

SEQ ID NO: 81 - DNA, 20 bp, Artificial Sequence
  Description of Artificial Sequence: Synthetic oligonucleotide
tcctgtcgttttttgtcgtt

SEQ ID NO: 82 - DNA, 21 bp, Artificial Sequence
  Description of Artificial Sequence: Synthetic oligonucleotide
tcgtcgctgtctgcccttctt

SEQ ID NO: 83 - DNA, 21 bp, Artificial Sequence
  Description of Artificial Sequence: Synthetic oligonucleotide
tcgtcgctgttgtcgtttctt

SEQ ID NO: 84 - DNA, 20 bp, Artificial Sequence
  Description of Artificial Sequence: Synthetic oligonucleotide
tccatgtcgttcctgtcgtt

SEQ ID NO: 85 - DNA, 20 bp, Artificial Sequence
  Description of Artificial Sequence: Synthetic oligonucleotide
tccaggacttctctcaggtt

SEQ ID NO: 86 - DNA, 20 bp, Artificial Sequence
  Description of Artificial Sequence: Synthetic oligonucleotide
tccatgcgtgcgtgcgtttt

SEQ ID NO: 87 - DNA, 20 bp, Artificial Sequence
  Description of Artificial Sequence: Synthetic oligonucleotide
tccatgcgttgcgttgcgtt

SEQ ID NO: 88 - DNA, 20 bp, Artificial Sequence
  Description of Artificial Sequence: Synthetic oligonucleotide
tccacgacgttttcgacgtt

SEQ ID NO: 89 - DNA, 20 bp, Artificial Sequence
  Description of Artificial Sequence: Synthetic oligonucleotide
tcgtcgttgtcgttgtcgtt

SEQ ID NO: 90 - DNA, 24 bp, Artificial Sequence
  Description of Artificial Sequence: Synthetic oligonucleotide
tcgtcgttttgtcgttttgtcgtt

SEQ ID NO: 91 - DNA, 22 bp, Artificial Sequence
  Description of Artificial Sequence: Synthetic oligonucleotide
tcgtcgttgtcgttttgtcgtt

SEQ ID NO: 92 - DNA, 21 bp, Artificial Sequence
  Description of Artificial Sequence: Synthetic oligonucleotide
gcgtgcgttgtcgttgtcgtt

SEQ ID NO: 93 - DNA, 20 bp, Artificial Sequence
  Description of Artificial Sequence: Synthetic oligonucleotide
gcggcgggcggcgcgcgccc

SEQ ID NO: 94 - DNA, 21 bp, Artificial Sequence
  Description of Artificial Sequence: Synthetic oligonucleotide
tgtcgtttgtcgtttgtcgtt

SEQ ID NO: 95 - DNA, 25 bp, Artificial Sequence
  Description of Artificial Sequence: Synthetic oligonucleotide
tgtcgttgtcgttgtcgttgtcgtt

SEQ ID NO: 96 - DNA, 19 bp, Artificial Sequence
  Description of Artificial Sequence: Synthetic oligonucleotide
tgtcgttgtcgttgtcgtt

SEQ ID NO: 97 - DNA, 14 bp, Artificial Sequence
  Description of Artificial Sequence: Synthetic oligonucleotide
tcgtcgtcgtcgtt

SEQ ID NO: 98 - DNA, 13 bp, Artificial Sequence
  Description of Artificial Sequence: Synthetic oligonucleotide
tgtcgttgtcgtt

SEQ ID NO: 99 - DNA, 20 bp, Artificial Sequence
  Description of Artificial Sequence: Synthetic oligonucleotide
tccatagcgttcctagcgtt

SEQ ID NO: 100 - DNA, 20 bp, Artificial Sequence
  Description of Artificial Sequence: Synthetic oligonucleotide
tccatgacgttcctgacgtt

SEQ ID NO: 101 - DNA, 6 bp, Artificial Sequence
  Description of Artificial Sequence: Synthetic oligonucleotide
gtcgyt

SEQ ID NO: 102 - DNA, 7 bp, Artificial Sequence
  Description of Artificial Sequence: Synthetic oligonucleotide
tgtcgyt

SEQ ID NO: 103 - DNA, 20 bp, Artificial Sequence
  Description of Artificial Sequence: Synthetic oligonucleotide
tccatgagcttcctgagtct

SEQ ID NO: 104 - DNA, 18 bp, Artificial Sequence
  Description of Artificial Sequence: Synthetic oligonucleotide
tctcccagcgtgcgccat

SEQ ID NO: 105 - DNA, 20 bp, Artificial Sequence
  Description of Artificial Sequence: Synthetic oligonucleotide
tccatgacgttcctgacgtt

SEQ ID NO: 106 - DNA, 20 bp, Artificial Sequence
  Description of Artificial Sequence: Synthetic oligonucleotide
gcctcagtctgcttcgcacc

SEQ ID NO: 107 - DNA, 13 bp, Artificial Sequence
  Description of Artificial Sequence: Synthetic oligonucleotide
aatcgatcgatcg

SEQ ID NO: 108 - DNA, 12 bp, Artificial Sequence
  Description of Artificial Sequence: Synthetic oligonucleotide
cagtctgcttcg

SEQ ID NO: 109 - DNA, 15 bp, Artificial Sequence
  Description of Artificial Sequence: Synthetic oligonucleotide
ctcagtctgcttcgc

SEQ ID NO: 110 - DNA, 20 bp, Artificial Sequence
  Description of Artificial Sequence: Synthetic oligonucleotide
  Description of Combined DNA/RNA Molecule: Synthetic oligonucleotide
gcctcagucugcttcgcacc

SEQ ID NO: 111 - RNA, 20 nt, Artificial Sequence
  Description of Artificial Sequence: Synthetic oligonucleotide
gccucagucugcuucgcacc

SEQ ID NO: 112 - DNA, 20 bp, Artificial Sequence
  Description of Artificial Sequence: Synthetic oligonucleotide
  Description of Combined DNA/RNA Molecule: Synthetic oligonucleotide
  modified_base (4)..(4): t or u
  modified_base (8)..(8): t or u
  modified_base (10)..(10): t or u
  modified_base (13)..(14): t or u
gccncagncngcnncgcacc

SEQ ID NO: 113 - DNA, 20 bp, Artificial Sequence
  Description of Artificial Sequence: Synthetic oligonucleotide
  Description of Combined DNA/RNA Molecule: Synthetic oligonucleotide
gccucagtctgcttcgcacc

SEQ ID NO: 114 - RNA, 20 nt, Artificial Sequence
  Description of Artificial Sequence: Synthetic oligonucleotide
ggugcgaagcagacugaggc

SEQ ID NO: 115 - DNA, 20 bp, Artificial Sequence
  Description of Artificial Sequence: Synthetic oligonucleotide
gatgcctctcctacgcgcct

SEQ ID NO: 116 - DNA, 24 bp, Artificial Sequence
  Description of Artificial Sequence: Synthetic primer
agccttggtggataccctgaagtt

SEQ ID NO: 117 - DNA, 24 bp, Artificial Sequence
  Description of Artificial Sequence: Synthetic primer
tggacaaggtcatactctgccgat

SEQ ID NO: 118 - DNA, 20 bp, Artificial Sequence
  Description of Artificial Sequence: Synthetic primer
ctctgctcctcctgttcgac

SEQ ID NO: 119 - DNA, 20 bp, Artificial Sequence
  Description of Artificial Sequence: Synthetic primer
acgaccaaatccgttgactc

SEQ ID NO: 120 - DNA, 20 bp, Artificial Sequence
  Description of Artificial Sequence: Synthetic oligonucleotide
gtccctgaagatgtcaatgc

SEQ ID NO: 121 - DNA, 21 bp, Artificial Sequence
  Description of Artificial Sequence: Synthetic oligonucleotide
  Description of Combined DNA/RNA Molecule: Synthetic oligonucleotide
uucuagaccuguuuugcuutt

SEQ ID NO: 122 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 123 - DNA, 20 bp, Artificial Sequence
  Description of Artificial Sequence: Synthetic oligonucleotide
  Description of Combined DNA/RNA Molecule: Synthetic oligonucleotide
agcaaaacaggucuagaatt

SEQ ID NO: 124 - RNA, 10 nt, Artificial Sequence
  Description of Artificial Sequence: Synthetic oligonucleotide
gguggaaggc

SEQ ID NO: 125 - DNA, 12 bp, Artificial Sequence
  Description of Artificial Sequence: Synthetic oligonucleotide
cagtctgcttcg

SEQ ID NO: 126 - DNA, 27 bp, Artificial Sequence
  Description of Artificial Sequence: Synthetic oligonucleotide
gcgtttgctcttcttcttgcgtttttt

SEQ ID NO: 127 - DNA, 19 bp, Artificial Sequence
  Description of Artificial Sequence: Synthetic oligonucleotide
cgtgggctccagcattcta

SEQ ID NO: 128 - DNA, 21 bp, Artificial Sequence
  Description of Artificial Sequence: Synthetic oligonucleotide
agtcatttctgcctttgcgtc

SEQ ID NO: 129 - DNA, 22 bp, Artificial Sequence
  Description of Artificial Sequence: Synthetic oligonucleotide
ccaatggtcgggcactgctcaa

SEQ ID NO: 130 - DNA, 20 bp, Artificial Sequence
  Description of Artificial Sequence: Synthetic oligonucleotide
ggcaaattcaacggcacagt

SEQ ID NO: 131 - DNA, 20 bp, Artificial Sequence
  Description of Artificial Sequence: Synthetic oligonucleotide
gggtctcgctcctggaagat

SEQ ID NO: 132 - DNA, 27 bp, Artificial Sequence
  Description of Artificial Sequence: Synthetic oligonucleotide
aaggccgagaatgggaagcttgtcatc

SEQ ID NO: 133 - DNA, 21 bp, Artificial Sequence
  Description of Artificial Sequence: Synthetic oligonucleotide
  Description of Combined DNA/RNA Molecule: Synthetic oligonucleotide
acaacagacuuuaauguaatt

SEQ ID NO: 134 - RNA, 19 nt, Artificial Sequence
  Description of Artificial Sequence: Synthetic oligonucleotide
acaacugacuuuaauguaa

SEQ ID NO: 135 - protein, 33 aa, Artificial Sequence
  Description of Artificial Sequence: Synthetic polypeptide
GLFEAIEGFIENGWEGMIDGWYGYGRKKRRQRR

SEQ ID NO: 136 - RNA, 21 nt, Artificial Sequence
  Description of Artificial Sequence: Synthetic oligonucleotide
uuacauuaaagucuguuguuu

SEQ ID NO: 137 - RNA, 21 nt, Artificial Sequence
  Description of Artificial Sequence: Synthetic oligonucleotide
auuucaggaauuguuaaaguu

SEQ ID NO: 138 - RNA, 21 nt, Artificial Sequence
  Description of Artificial Sequence: Synthetic oligonucleotide
ugacauuaaagucuguuguuu

SEQ ID NO: 139 - DNA, 21 bp, Artificial Sequence
  Description of Artificial Sequence: Synthetic oligonucleotide
  Description of Combined DNA/RNA Molecule: Synthetic oligonucleotide
uaaaaucuuccugcccacctt

SEQ ID NO: 140 - DNA, 21 bp, Artificial Sequence
  Description of Artificial Sequence: Synthetic oligonucleotide
  Description of Combined DNA/RNA Molecule: Synthetic oligonucleotide
ggaagcuguuggcugaaaatt

SEQ ID NO: 141 - DNA, 21 bp, Artificial Sequence
  Description of Artificial Sequence: Synthetic oligonucleotide
  Description of Combined DNA/RNA Molecule: Synthetic oligonucleotide
cacauccagcccaucuguctt

SEQ ID NO: 142 - DNA, 21 bp, Artificial Sequence
  Description of Artificial Sequence: Synthetic oligonucleotide
  Description of Combined DNA/RNA Molecule: Synthetic oligonucleotide
ccgugcuccuggggcugggtt

SEQ ID NO: 143 - DNA, 21 bp, Artificial Sequence
  Description of Artificial Sequence: Synthetic oligonucleotide
  Description of Combined DNA/RNA Molecule: Synthetic oligonucleotide
ggaguuggaucucucagaatt

SEQ ID NO: 144 - DNA, 21 bp, Artificial Sequence
  Description of Artificial Sequence: Synthetic oligonucleotide
aagtcccgctcattacaaatt

SEQ ID NO: 145 - RNA, 21 nt, Artificial Sequence
  Description of Artificial Sequence: Synthetic oligonucleotide
aagaccagccucuuugcccag

SEQ ID NO: 146 - DNA, 19 bp, Artificial Sequence
  Description of Artificial Sequence: Synthetic oligonucleotide
ggaccaggcagaaaacgag

SEQ ID NO: 147 - RNA, 17 nt, Artificial Sequence
  Description of Artificial Sequence: Synthetic oligonucleotide
cuaucaggaugacgcgg

SEQ ID NO: 148 - DNA, 23 bp, Artificial Sequence
  Description of Artificial Sequence: Synthetic oligonucleotide
  Description of Combined DNA/RNA Molecule: Synthetic oligonucleotide
aaccaccugggccaguauuautt

SEQ ID NO: 149 - RNA, 21 nt, Artificial Sequence
  Description of Artificial Sequence: Synthetic oligonucleotide
ugacacaggcaggcuugacuu

SEQ ID NO: 150 - RNA, 21 nt, Artificial Sequence
  Description of Artificial Sequence: Synthetic oligonucleotide
aagcucaauucggacaacaag

SEQ ID NO: 151 - RNA, 21 nt, Artificial Sequence
  Description of Artificial Sequence: Synthetic oligonucleotide
aaguccuguaugagugggaac

SEQ ID NO: 152 - DNA, 59 bp, Artificial Sequence
  Description of Artificial Sequence: Synthetic oligonucleotide
tcgacgaacatctacaacgcctgcttcaagagagcaggcgttgtagatgttcttttttt

SEQ ID NO: 153 - DNA, 59 bp, Artificial Sequence
  Description of Artificial Sequence: Synthetic oligonucleotide
tcgaccaatgacaagagccgtgacttcaagagagtcacggctcttgtcattgttttttt

SEQ ID NO: 154 - DNA, 19 bp, Artificial Sequence
  Description of Artificial Sequence: Synthetic oligonucleotide
ggtgaagaagggcgtccaa

SEQ ID NO: 155 - DNA, 62 bp, Artificial Sequence
  Description of Artificial Sequence: Synthetic oligonucleotide
gatccgttggagctgttggcgtagttcaagagactacgccaacagctccaactttttggaaa

SEQ ID NO: 156 - DNA, 20 bp, Artificial Sequence
  Description of Artificial Sequence: Synthetic oligonucleotide
aggtggtgttaacagcagag

SEQ ID NO: 157 - DNA, 20 bp, Artificial Sequence
  Description of Artificial Sequence: Synthetic oligonucleotide
aatgttccaatgccccactc

SEQ ID NO: 158 - RNA, 21 nt, Artificial Sequence
  Description of Artificial Sequence: Synthetic oligonucleotide
aacugccaguggccagggccu

SEQ ID NO: 159 - RNA, 21 nt, Artificial Sequence
  Description of Artificial Sequence: Synthetic oligonucleotide
aaccugcggucuggagucaac

SEQ ID NO: 160 - RNA, 21 nt, Artificial Sequence
  Description of Artificial Sequence: Synthetic oligonucleotide
uaauccaauucgaagaccaau

SEQ ID NO: 161 - DNA, 21 bp, Artificial Sequence
  Description of Artificial Sequence: Synthetic oligonucleotide
aggggcagcaactgatgaaaa

SEQ ID NO: 162 - DNA, 21 bp, Artificial Sequence
  Description of Artificial Sequence: Synthetic oligonucleotide
aaggcatcgcagaaggtttat

SEQ ID NO: 163 - RNA, 19 nt, Artificial Sequence
  Description of Artificial Sequence: Synthetic oligonucleotide
ucgaaguacucagcguaag

SEQ ID NO: 164 - RNA, 19 nt, Artificial Sequence
  Description of Artificial Sequence: Synthetic oligonucleotide
gaaccugaggaccaagaac

SEQ ID NO: 165 - DNA, 29 bp, Artificial Sequence
  Description of Artificial Sequence: Synthetic oligonucleotide
aatgttctcttccaggtcagccctgtctc

SEQ ID NO: 166 - RNA, 21 nt, Artificial Sequence
  Description of Artificial Sequence: Synthetic oligonucleotide
aagaaguacgagaagcuggag

SEQ ID NO: 167 - RNA, 21 nt, Artificial Sequence
  Description of Artificial Sequence: Synthetic oligonucleotide
aagcaagcuguagaacacgua

SEQ ID NO: 168 - RNA, 21 nt, Artificial Sequence
  Description of Artificial Sequence: Synthetic oligonucleotide
aagccgugcaaagaacucuuu

SEQ ID NO: 169 - RNA, 21 nt, Artificial Sequence
  Description of Artificial Sequence: Synthetic oligonucleotide
aacaguagguuuguagugagc

SEQ ID NO: 170 - RNA, 21 nt, Artificial Sequence
  Description of Artificial Sequence: Synthetic oligonucleotide
aaaggggcauccacagacauc

SEQ ID NO: 171 - DNA, 20 bp, Artificial Sequence
  Description of Artificial Sequence: Synthetic oligonucleotide
ttattcttctctttggagga

SEQ ID NO: 172 - DNA, 19 bp, Artificial Sequence
  Description of Artificial Sequence: Synthetic oligonucleotide
actggacttccagaagaac

SEQ ID NO: 173 - DNA, 21 bp, Artificial Sequence
  Description of Artificial Sequence: Synthetic oligonucleotide
aattgcacgtaatcacccaaa

SEQ ID NO: 174 - DNA, 21 bp, Artificial Sequence
  Description of Artificial Sequence: Synthetic oligonucleotide
aagaaatacaaggaagatgag

SEQ ID NO: 175 - DNA, 21 bp, Artificial Sequence
  Description of Artificial Sequence: Synthetic oligonucleotide
  Description of Combined DNA/RNA Molecule: Synthetic oligonucleotide
gacaugcuugcucauaguctt

SEQ ID NO: 176 - DNA, 21 bp, Artificial Sequence
  Description of Artificial Sequence: Synthetic oligonucleotide
  Description of Combined DNA/RNA Molecule: Synthetic oligonucleotide
gaccugccuccucaucguctt

SEQ ID NO: 177 - DNA, 21 bp, Artificial Sequence
  Description of Artificial Sequence: Synthetic oligonucleotide
aaggtggagcaagcggtggag

SEQ ID NO: 178 - DNA, 21 bp, Artificial Sequence
  Description of Artificial Sequence: Synthetic oligonucleotide
aaggagttgaaggcctacaaa

SEQ ID NO: 179 - DNA, 21 bp, Artificial Sequence
  Description of Artificial Sequence: Synthetic oligonucleotide
  Description of Combined DNA/RNA Molecule: Synthetic oligonucleotide
ugccuacgaacucuucacctt

SEQ ID NO: 180 - DNA, 21 bp, Artificial Sequence
  Description of Artificial Sequence: Synthetic oligonucleotide
  Description of Combined DNA/RNA Molecule: Synthetic oligonucleotide
uauggagcugcagaggaugtt

SEQ ID NO: 181 - DNA, 19 bp, Artificial Sequence
  Description of Artificial Sequence: Synthetic oligonucleotide
ttggccaagccacacacag

SEQ ID NO: 182 - DNA, 19 bp, Artificial Sequence
  Description of Artificial Sequence: Synthetic oligonucleotide
gttctcagccattgctagc

SEQ ID NO: 183 - DNA, 19 bp, Artificial Sequence
  Description of Artificial Sequence: Synthetic oligonucleotide
ggcagcatgtattgctgag

SEQ ID NO: 184 - RNA, 21 nt, Artificial Sequence
  Description of Artificial Sequence: Synthetic oligonucleotide
aauccaggacucauuccagau

SEQ ID NO: 185 - RNA, 21 nt, Artificial Sequence
  Description of Artificial Sequence: Synthetic oligonucleotide
aagugaagaauacgaucaagu

SEQ ID NO: 186 - RNA, 21 nt, Artificial Sequence
  Description of Artificial Sequence: Synthetic oligonucleotide
aacaacgaguaccucaacccu

SEQ ID NO: 187 - RNA, 21 nt, Artificial Sequence
  Description of Artificial Sequence: Synthetic oligonucleotide
aacgcuugagcuggaaguaag

SEQ ID NO: 188 - RNA, 19 nt, Artificial Sequence
  Description of Artificial Sequence: Synthetic oligonucleotide
ccuucaagcuucugaucuc

SEQ ID NO: 189 - RNA, 21 nt, Artificial Sequence
  Description of Artificial Sequence: Synthetic oligonucleotide
aacuucgacuuugucaccgag

SEQ ID NO: 190 - RNA, 22 nt, Artificial Sequence
  Description of Artificial Sequence: Synthetic oligonucleotide
aagcacugcagagacauggaag

SEQ ID NO: 191 - DNA, 21 bp, Artificial Sequence
  Description of Artificial Sequence: Synthetic oligonucleotide
aacagccatggatacacttga

SEQ ID NO: 192 - DNA, 20 bp, Artificial Sequence
  Description of Artificial Sequence: Synthetic oligonucleotide
aatgacaaagaggcagcagg

SEQ ID NO: 193 - DNA, 20 bp, Artificial Sequence
  Description of Artificial Sequence: Synthetic oligonucleotide
aacctgccacactcaagatc

SEQ ID NO: 194 - DNA, 21 bp, Artificial Sequence
  Description of Artificial Sequence: Synthetic oligonucleotide
agctgaacttcaggagctgcc

SEQ ID NO: 195 - DNA, 21 bp, Artificial Sequence
  Description of Artificial Sequence: Synthetic oligonucleotide
aagcctttcgcaagttcctga

SEQ ID NO: 196 - DNA, 20 bp, Artificial Sequence
  Description of Artificial Sequence: Synthetic oligonucleotide
acggcataggcgatgaggag

SEQ ID NO: 197 - DNA, 20 bp, Artificial Sequence
  Description of Artificial Sequence: Synthetic oligonucleotide
aggaaggccgggtgattgtg

SEQ ID NO: 198 - DNA, 19 bp, Artificial Sequence
  Description of Artificial Sequence: Synthetic oligonucleotide
gtctggtacgactggagta

SEQ ID NO: 199 - DNA, 20 bp, Artificial Sequence
  Description of Artificial Sequence: Synthetic oligonucleotide
gacagctttaggcacctcta

SEQ ID NO: 200 - RNA, 19 nt, Artificial Sequence
  Description of Artificial Sequence: Synthetic oligonucleotide
ggauucgaacugcacuucu

SEQ ID NO: 201 - RNA, 19 nt, Artificial Sequence
  Description of Artificial Sequence: Synthetic oligonucleotide
acuguggcacccagcuugu

SEQ ID NO: 202 - RNA, 19 nt, Artificial Sequence
  Description of Artificial Sequence: Synthetic oligonucleotide
gcccaaagugaaucccuuc

SEQ ID NO: 203 - DNA, 49 bp, Artificial Sequence
  Description of Artificial Sequence: Synthetic oligonucleotide
tttgaatatctgtgctgagaacacagttctcagcacagatattcttttt

SEQ ID NO: 204 - DNA, 49 bp, Artificial Sequence
  Description of Artificial Sequence: Synthetic oligonucleotide
tttgtcaattagctggaacatcacagatgttccagctaattgacttttt

SEQ ID NO: 205 - DNA, 29 bp, Artificial Sequence
  Description of Artificial Sequence: Synthetic oligonucleotide
aatgagaaaagcaaaaggtgccctgtctc

SEQ ID NO: 206 - RNA, 22 nt, Artificial Sequence
  Description of Artificial Sequence: Synthetic oligonucleotide
caucgaugugugugagaacugc

SEQ ID NO: 207 - RNA, 22 nt, Artificial Sequence
  Description of Artificial Sequence: Synthetic oligonucleotide
cuguucucagcuggagaagcuu

SEQ ID NO: 208 - RNA, 22 nt, Artificial Sequence
  Description of Artificial Sequence: Synthetic oligonucleotide
ggagccuucaugguaagggauu

SEQ ID NO: 209 - DNA, 15 bp, Artificial Sequence
  Description of Artificial Sequence: Synthetic oligonucleotide
ggcaccatgaaggcg

SEQ ID NO: 210 - DNA, 21 bp, Artificial Sequence
  Description of Artificial Sequence: Synthetic oligonucleotide
  Description of Combined DNA/RNA Molecule: Synthetic oligonucleotide
cugggcuguacuuuguauatt

SEQ ID NO: 211 - RNA, 21 nt, Artificial Sequence
  Description of Artificial Sequence: Synthetic oligonucleotide
auguagccuggagauccauuu

SEQ ID NO: 212 - DNA, 23 bp, Artificial Sequence
  Description of Artificial Sequence: Synthetic oligonucleotide
  Description of Combined DNA/RNA Molecule: Synthetic oligonucleotide
ccucagggcagagaaccaucutt

SEQ ID NO: 213 - DNA, 23 bp, Artificial Sequence
  Description of Artificial Sequence: Synthetic oligonucleotide
  Description of Combined DNA/RNA Molecule: Synthetic oligonucleotide
cuggacuuccagaagaacauctt

SEQ ID NO: 214 - RNA, 21 nt, Artificial Sequence
  Description of Artificial Sequence: Synthetic oligonucleotide
aagauccgccagagccccucg

SEQ ID NO: 215 - DNA, 21 bp, Artificial Sequence
  Description of Artificial Sequence: Synthetic oligonucleotide
aacagggactcacgtgaagct

SEQ ID NO: 216 - DNA, 21 bp, Artificial Sequence
  Description of Artificial Sequence: Synthetic oligonucleotide
aagacctgtttgatctgatcc

SEQ ID NO: 217 - DNA, 21 bp, Artificial Sequence
  Description of Artificial Sequence: Synthetic oligonucleotide
  Description of Combined DNA/RNA Molecule: Synthetic oligonucleotide
uagacugacccagcuggaatt

SEQ ID NO: 218 - DNA, 21 bp, Artificial Sequence
  Description of Artificial Sequence: Synthetic oligonucleotide
  Description of Combined DNA/RNA Molecule: Synthetic oligonucleotide
gaugcaauuacacaacagatt

SEQ ID NO: 219 - RNA, 19 nt, Artificial Sequence
  Description of Artificial Sequence: Synthetic oligonucleotide
cucaggagaggagccauuu

SEQ ID NO: 220 - RNA, 19 nt, Artificial Sequence
  Description of Artificial Sequence: Synthetic oligonucleotide
gauugaagacacaggaggc

SEQ ID NO: 221 - RNA, 19 nt, Artificial Sequence
  Description of Artificial Sequence: Synthetic oligonucleotide
gcaacucuggaugggauug

SEQ ID NO: 222 - RNA, 19 nt, Artificial Sequence
  Description of Artificial Sequence: Synthetic oligonucleotide
ggaguucaugagugcuaua

SEQ ID NO: 223 - RNA, 19 nt, Artificial Sequence
  Description of Artificial Sequence: Synthetic oligonucleotide
cagaggaaccugcuggcga

SEQ ID NO: 224 - DNA, 21 bp, Artificial Sequence
  Description of Artificial Sequence: Synthetic oligonucleotide
aactggcaacctccagagaat

SEQ ID NO: 225 - DNA, 21 bp, Artificial Sequence
  Description of Artificial Sequence: Synthetic oligonucleotide
aagagacctcgtggagaaact

SEQ ID NO: 226 - DNA, 21 bp, Artificial Sequence
  Description of Artificial Sequence: Synthetic oligonucleotide
aacagtagaggagccgtcaaa

SEQ ID NO: 227 - DNA, 21 bp, Artificial Sequence
  Description of Artificial Sequence: Synthetic oligonucleotide
  Description of Combined DNA/RNA Molecule: Synthetic oligonucleotide
gggugagaccaucuucauctt

SEQ ID NO: 228 - DNA, 21 bp, Artificial Sequence
  Description of Artificial Sequence: Synthetic oligonucleotide
  Description of Combined DNA/RNA Molecule: Synthetic oligonucleotide
ggccaaagucuaugaagautt

SEQ ID NO: 229 - RNA, 21 nt, Artificial Sequence
  Description of Artificial Sequence: Synthetic oligonucleotide
aaucaucaucaagaaagggca

SEQ ID NO: 230 - DNA, 21 bp, Artificial Sequence
  Description of Artificial Sequence: Synthetic oligonucleotide
  Description of Combined DNA/RNA Molecule: Synthetic oligonucleotide
aauugcuggagcuggccuutt

SEQ ID NO: 231 - DNA, 19 bp, Artificial Sequence
  Description of Artificial Sequence: Synthetic oligonucleotide
gaatgaagatcgatagtaa

SEQ ID NO: 232 - DNA, 19 bp, Artificial Sequence
  Description of Artificial Sequence: Synthetic oligonucleotide
gcacaggtgtagcaagtaa

SEQ ID NO: 233 - DNA, 19 bp, Artificial Sequence
  Description of Artificial Sequence: Synthetic oligonucleotide
ggagaattatgctttgaaa

SEQ ID NO: 234 - DNA, 19 bp, Artificial Sequence
  Description of Artificial Sequence: Synthetic oligonucleotide
gcagtgctttgcagtatga

SEQ ID NO: 235 - DNA, 19 bp, Artificial Sequence
  Description of Artificial Sequence: Synthetic oligonucleotide
cagaaagccttgcgagttt

SEQ ID NO: 236 - DNA, 19 bp, Artificial Sequence
  Description of Artificial Sequence: Synthetic oligonucleotide
gaatttggattgccacaga

SEQ ID NO: 237 - DNA, 19 bp, Artificial Sequence
  Description of Artificial Sequence: Synthetic oligonucleotide
gaaggtgttcccactgata

SEQ ID NO: 238 - DNA, 19 bp, Artificial Sequence
  Description of Artificial Sequence: Synthetic oligonucleotide
gagagggtcctgcaaagaa

SEQ ID NO: 239 - RNA, 19 nt, Artificial Sequence
  Description of Artificial Sequence: Synthetic oligonucleotide
ugaugaaaaugagcaccag

SEQ ID NO: 240 - DNA, 21 bp, Artificial Sequence
  Description of Artificial Sequence: Synthetic oligonucleotide
aaaatccctgccagaaccacc

SEQ ID NO: 241 - DNA, 21 bp, Artificial Sequence
  Description of Artificial Sequence: Synthetic oligonucleotide
aacaagaccttcgactcttcc

SEQ ID NO: 242 - DNA, 19 bp, Artificial Sequence
  Description of Artificial Sequence: Synthetic oligonucleotide
aaacgaaagcgagtacact

SEQ ID NO: 243 - DNA, 21 bp, Artificial Sequence
  Description of Artificial Sequence: Synthetic oligonucleotide
agatggacttctctgtacagg

SEQ ID NO: 244 - DNA, 21 bp, Artificial Sequence
  Description of Artificial Sequence: Synthetic oligonucleotide
gacattgtctgtctctgagga

SEQ ID NO: 245 - DNA, 21 bp, Artificial Sequence
  Description of Artificial Sequence: Synthetic oligonucleotide
  Description of Combined DNA/RNA Molecule: Synthetic oligonucleotide
ggacuuauccuggcuagagtt

SEQ ID NO: 246 - DNA, 21 bp, Artificial Sequence
  Description of Artificial Sequence: Synthetic oligonucleotide
  Description of Combined DNA/RNA Molecule: Synthetic oligonucleotide
ccggaucuacucgacuccctt

SEQ ID NO: 247 - DNA, 21 bp, Artificial Sequence
  Description of Artificial Sequence: Synthetic oligonucleotide
  Description of Combined DNA/RNA Molecule: Synthetic oligonucleotide
ccuaaucacacacucuguatt

SEQ ID NO: 248 - DNA, 21 bp, Artificial Sequence
  Description of Artificial Sequence: Synthetic oligonucleotide
  Description of Combined DNA/RNA Molecule: Synthetic oligonucleotide
acugcagacaaaacaccuutt

SEQ ID NO: 249 - DNA, 21 bp, Artificial Sequence
  Description of Artificial Sequence: Synthetic oligonucleotide
  Description of Combined DNA/RNA Molecule: Synthetic oligonucleotide
uccaaccucuggguccguutt

SEQ ID NO: 250 - DNA, 21 bp, Artificial Sequence
  Description of Artificial Sequence: Synthetic oligonucleotide
  Description of Combined DNA/RNA Molecule: Synthetic oligonucleotide
acugugaccguuucugugutt

SEQ ID NO: 251 - DNA, 21 bp, Artificial Sequence
  Description of Artificial Sequence: Synthetic oligonucleotide
  Description of Combined DNA/RNA Molecule: Synthetic oligonucleotide
cucagacucuacagauugctt

SEQ ID NO: 252 - DNA, 19 bp, Artificial Sequence
  Description of Artificial Sequence: Synthetic oligonucleotide
  Description of Combined DNA/RNA Molecule: Synthetic oligonucleotide
gggcaaggccuugcagcuc

SEQ ID NO: 253 - DNA, 21 bp, Artificial Sequence
  Description of Artificial Sequence: Synthetic oligonucleotide
  Description of Combined DNA/RNA Molecule: Synthetic oligonucleotide
augacugucaggauguugctt

SEQ ID NO: 254 - RNA, 21 nt, Artificial Sequence
  Description of Artificial Sequence: Synthetic oligonucleotide
gcaacauccugacagucaucc

SEQ ID NO: 255 - DNA, 21 bp, Artificial Sequence
  Description of Artificial Sequence: Synthetic oligonucleotide
  Description of Combined DNA/RNA Molecule: Synthetic oligonucleotide
ugaacggugcugucauguatt

SEQ ID NO: 256 - DNA, 21 bp, Artificial Sequence
  Description of Artificial Sequence: Synthetic oligonucleotide
  Description of Combined DNA/RNA Molecule: Synthetic oligonucleotide
gcagagguucggcaugaautt

SEQ ID NO: 257 - DNA, 21 bp, Artificial Sequence
  Description of Artificial Sequence: Synthetic oligonucleotide
aagatgttcgtggacctgaac

SEQ ID NO: 258 - DNA, 38 bp, Artificial Sequence
  Description of Artificial Sequence: Synthetic oligonucleotide
aagatgattgttcgtccctgctatagtgagtcgtatta

SEQ ID NO: 259 - RNA, 21 nt, Artificial Sequence
  Description of Artificial Sequence: Synthetic oligonucleotide
gaacgaauccugaagacaucu

SEQ ID NO: 260 - RNA, 19 nt, Artificial Sequence
  Description of Artificial Sequence: Synthetic oligonucleotide
gaaggaagcuuugcuagcu

SEQ ID NO: 261 - DNA, 29 bp, Artificial Sequence
  Description of Artificial Sequence: Synthetic oligonucleotide
aagcctggctacagcaatatgcctgtctc

SEQ ID NO: 262 - RNA, 19 nt, Artificial Sequence
  Description of Artificial Sequence: Synthetic oligonucleotide
ggcucauuugcacucaauu

SEQ ID NO: 263 - RNA, 19 nt, Artificial Sequence
  Description of Artificial Sequence: Synthetic oligonucleotide
gccacaaaucugauaguau

SEQ ID NO: 264 - RNA, 19 nt, Artificial Sequence
  Description of Artificial Sequence: Synthetic oligonucleotide
cuggacuuccagaagaaca

SEQ ID NO: 265 - DNA, 21 bp, Artificial Sequence
  Description of Artificial Sequence: Synthetic oligonucleotide
  Description of Combined DNA/RNA Molecule: Synthetic oligonucleotide
ugaccaucaccgaguuuautt

SEQ ID NO: 266 - DNA, 17 bp, Artificial Sequence
  Description of Artificial Sequence: Synthetic oligonucleotide
gattataggaaatgttg

SEQ ID NO: 267 - DNA, 21 bp, Artificial Sequence
  Description of Artificial Sequence: Synthetic oligonucleotide
aagaaggcagatgaggggtta

SEQ ID NO: 268 - DNA, 21 bp, Artificial Sequence
  Description of Artificial Sequence: Synthetic oligonucleotide
aacaaagatggaccaacacag

SEQ ID NO: 269 - DNA, 21 bp, Artificial Sequence
  Description of Artificial Sequence: Synthetic oligonucleotide
  Description of Combined DNA/RNA Molecule: Synthetic oligonucleotide
ggacgaggucugcgugaautt

SEQ ID NO: 270 - RNA, 21 nt, Artificial Sequence
  Description of Artificial Sequence: Synthetic oligonucleotide
aagaaacgcgguaaucggacu

SEQ ID NO: 271 - DNA, 47 bp, Artificial Sequence
  Description of Artificial Sequence: Synthetic oligonucleotide
gcacaaagagcttgctcccttcaagagagggagcaagctctttgtgc

SEQ ID NO: 272 - DNA, 47 bp, Artificial Sequence
  Description of Artificial Sequence: Synthetic oligonucleotide
gtccgggaagctgaaagtcttcaagagagactttcagcttcccggac

SEQ ID NO: 273 - DNA, 47 bp, Artificial Sequence
  Description of Artificial Sequence: Synthetic oligonucleotide
gagatctggacagaatcgcttcaagagagcgattctgtccagatctc

SEQ ID NO: 274 - DNA, 19 bp, Artificial Sequence
  Description of Artificial Sequence: Synthetic oligonucleotide
ggagaacagcattaaactg

SEQ ID NO: 275 - DNA, 19 bp, Artificial Sequence
  Description of Artificial Sequence: Synthetic oligonucleotide
ggtcaacattctgatgtct

SEQ ID NO: 276 - DNA, 19 bp, Artificial Sequence
  Description of Artificial Sequence: Synthetic oligonucleotide
gggcaaggccttgcagctc

SEQ ID NO: 277 - DNA, 21 bp, Artificial Sequence
  Description of Artificial Sequence: Synthetic oligonucleotide
gtacaatgatgacatccgtaa

SEQ ID NO: 278 - DNA, 21 bp, Artificial Sequence
  Description of Artificial Sequence: Synthetic oligonucleotide
gtacgtccgcgggttgctgca

SEQ ID NO: 279 - RNA, 21 nt, Artificial Sequence
  Description of Artificial Sequence: Synthetic oligonucleotide
aagcauguggccugcuaugga

SEQ ID NO: 280 - DNA, 65 bp, Artificial Sequence
  Description of Artificial Sequence: Synthetic oligonucleotide
gatcccgcctcaacaacaacaacaacttcaagagagttgttgttgttgttgaggttttttggaaa

SEQ ID NO: 281 - RNA, 21 nt, Artificial Sequence
  Description of Artificial Sequence: Synthetic oligonucleotide
aagaagagcuucgagacuuuc

SEQ ID NO: 282 - DNA, 21 bp, Artificial Sequence
  Description of Artificial Sequence: Synthetic oligonucleotide
aactgggagagtacggtttcc

SEQ ID NO: 283 - DNA, 21 bp, Artificial Sequence
  Description of Artificial Sequence: Synthetic oligonucleotide
aagtcggacgcaacagagaaa

SEQ ID NO: 284 - RNA, 21 nt, Artificial Sequence
  Description of Artificial Sequence: Synthetic oligonucleotide
ggccaaccagaugcggcuguu

SEQ ID NO: 285 - RNA, 21 nt, Artificial Sequence
  Description of Artificial Sequence: Synthetic oligonucleotide
gauguuugacauccucuucuu

SEQ ID NO: 286 - RNA, 21 nt, Artificial Sequence
  Description of Artificial Sequence: Synthetic oligonucleotide
ggcugcaagcaguauuuacuu

SEQ ID NO: 287 - RNA, 21 nt, Artificial Sequence
  Description of Artificial Sequence: Synthetic oligonucleotide
ggacagagucagauuacaguu

SEQ ID NO: 288 - DNA, 23 bp, Artificial Sequence
  Description of Artificial Sequence: Synthetic oligonucleotide
agccactgtggaagaagtatatt

SEQ ID NO: 289 - DNA, 21 bp, Artificial Sequence
  Description of Artificial Sequence: Synthetic oligonucleotide
  Description of Combined DNA/RNA Molecule: Synthetic oligonucleotide
cccucugguuggugauucatt

SEQ ID NO: 290 - DNA, 21 bp, Artificial Sequence
  Description of Artificial Sequence: Synthetic oligonucleotide
  Description of Combined DNA/RNA Molecule: Synthetic oligonucleotide
ggaugauggcaccuuccuatt

SEQ ID NO: 291 - DNA, 21 bp, Artificial Sequence
  Description of Artificial Sequence: Synthetic oligonucleotide
aattggagatgaagatgtagg

SEQ ID NO: 292 - DNA, 21 bp, Artificial Sequence
  Description of Artificial Sequence: Synthetic oligonucleotide
  Description of Combined DNA/RNA Molecule: Synthetic oligonucleotide
caguuccgccacuugccaatt

SEQ ID NO: 293 - DNA, 21 bp, Artificial Sequence
  Description of Artificial Sequence: Synthetic oligonucleotide
  Description of Combined DNA/RNA Molecule: Synthetic oligonucleotide
agccugguggacauuuauutt

SEQ ID NO: 294 - DNA, 21 bp, Artificial Sequence
  Description of Artificial Sequence: Synthetic oligonucleotide
  Description of Combined DNA/RNA Molecule: Synthetic oligonucleotide
gaugugugaaacucugaactt

SEQ ID NO: 295 - DNA, 21 bp, Artificial Sequence
  Description of Artificial Sequence: Synthetic oligonucleotide
  Description of Combined DNA/RNA Molecule: Synthetic oligonucleotide
cagauggguaaggauggcatt

SEQ ID NO: 296 - RNA, 21 nt, Artificial Sequence
  Description of Artificial Sequence: Synthetic oligonucleotide
aagcacuaucauugcgaaucc

SEQ ID NO: 297 - DNA, 21 bp, Artificial Sequence
  Description of Artificial Sequence: Synthetic oligonucleotide
aactgggcgagtattacatga

SEQ ID NO: 298 - DNA, 19 bp, Artificial Sequence
  Description of Artificial Sequence: Synthetic oligonucleotide
tgaacaaagtgagagacat

SEQ ID NO: 299 - DNA, 21 bp, Artificial Sequence
  Description of Artificial Sequence: Synthetic oligonucleotide
aatgtgtgaatgacaactact

SEQ ID NO: 300 - DNA, 21 bp, Artificial Sequence
  Description of Artificial Sequence: Synthetic oligonucleotide
aatacggactcaccttgcttg

SEQ ID NO: 301 - DNA, 22 bp, Artificial Sequence
  Description of Artificial Sequence: Synthetic oligonucleotide
  Description of Combined DNA/RNA Molecule: Synthetic oligonucleotide
ccgccgcuuccauuuuuccutt

SEQ ID NO: 302 - DNA, 23 bp, Artificial Sequence
  Description of Artificial Sequence: Synthetic oligonucleotide
  Description of Combined DNA/RNA Molecule: Synthetic oligonucleotide
aggaaaaauggaagcggcgggtt

SEQ ID NO: 303 - DNA, 21 bp, Artificial Sequence
  Description of Artificial Sequence: Synthetic oligonucleotide
  Description of Combined DNA/RNA Molecule: Synthetic oligonucleotide
ccuggaacucaccuaccugtt

SEQ ID NO: 304 - DNA, 21 bp, Artificial Sequence
  Description of Artificial Sequence: Synthetic oligonucleotide
  Description of Combined DNA/RNA Molecule: Synthetic oligonucleotide
cuaccuuucuacggacgugtt

SEQ ID NO: 305 - DNA, 21 bp, Artificial Sequence
  Description of Artificial Sequence: Synthetic oligonucleotide
  Description of Combined DNA/RNA Molecule: Synthetic oligonucleotide
gauccggaaguacacgaugtt

SEQ ID NO: 306 - RNA, 19 nt, Artificial Sequence
  Description of Artificial Sequence: Synthetic oligonucleotide
gaaggaauccuccaaguca

SEQ ID NO: 307 - DNA, 21 bp, Artificial Sequence
  Description of Artificial Sequence: Synthetic oligonucleotide
aagctccatgtcacagtacga

SEQ ID NO: 308 - DNA, 21 bp, Artificial Sequence
  Description of Artificial Sequence: Synthetic oligonucleotide
aagcgctgcgtcatgaatgtt

SEQ ID NO: 309 - DNA, 21 bp, Artificial Sequence
  Description of Artificial Sequence: Synthetic oligonucleotide
ctgcctaaggcggatttgaat

SEQ ID NO: 310 - DNA, 21 bp, Artificial Sequence
  Description of Artificial Sequence: Synthetic oligonucleotide
ggcaggcgacgagtttgaact

SEQ ID NO: 311 - DNA, 21 bp, Artificial Sequence
  Description of Artificial Sequence: Synthetic oligonucleotide
gtgcgtggaaagcgtagacaa

SEQ ID NO: 312 - DNA, 21 bp, Artificial Sequence
  Description of Artificial Sequence: Synthetic oligonucleotide
ggcggagttcacagctctata

SEQ ID NO: 313 - DNA, 21 bp, Artificial Sequence
  Description of Artificial Sequence: Synthetic oligonucleotide
gtgggcataagtgctgatcta

SEQ ID NO: 314 - DNA, 21 bp, Artificial Sequence
  Description of Artificial Sequence: Synthetic oligonucleotide
ctcggtcctgcgattattaat

SEQ ID NO: 315 - DNA, 53 bp, Artificial Sequence
  Description of Artificial Sequence: Synthetic oligonucleotide
aaggccgagatcagcaaagttcaagagactttgctgatctcggcctttttttt

SEQ ID NO: 316 - DNA, 21 bp, Artificial Sequence
  Description of Artificial Sequence: Synthetic oligonucleotide
  Description of Combined DNA/RNA Molecule: Synthetic oligonucleotide
ggccagccaucacaaucaatt

SEQ ID NO: 317 - DNA, 21 bp, Artificial Sequence
  Description of Artificial Sequence: Synthetic oligonucleotide
  Description of Combined DNA/RNA Molecule: Synthetic oligonucleotide
ggaacuucuaaaugaaccatt

SEQ ID NO: 318 - DNA, 21 bp, Artificial Sequence
  Description of Artificial Sequence: Synthetic oligonucleotide
  Description of Combined DNA/RNA Molecule: Synthetic oligonucleotide
gguccaguuaagguuuugutt

SEQ ID NO: 319 - DNA, 21 bp, Artificial Sequence
  Description of Artificial Sequence: Synthetic oligonucleotide
  Description of Combined DNA/RNA Molecule: Synthetic oligonucleotide
gguuaccuuccaccuacaatt

SEQ ID NO: 320 - RNA, 21 nt, Artificial Sequence
  Description of Artificial Sequence: Synthetic oligonucleotide
aaguggaugccuuucggguca

SEQ ID NO: 321 - RNA, 21 nt, Artificial Sequence
  Description of Artificial Sequence: Synthetic oligonucleotide
aaggagaacaguucuugcggc

SEQ ID NO: 322 - RNA, 21 nt, Artificial Sequence
  Description of Artificial Sequence: Synthetic oligonucleotide
aagguccagucauuccaaaug

SEQ ID NO: 323 - DNA, 22 bp, Artificial Sequence
  Description of Artificial Sequence: Synthetic oligonucleotide
  Description of Combined DNA/RNA Molecule: Synthetic oligonucleotide
aggaaggaccuguugaccuutt

SEQ ID NO: 324 - DNA, 21 bp, Artificial Sequence
  Description of Artificial Sequence: Synthetic oligonucleotide
  Description of Combined DNA/RNA Molecule: Synthetic oligonucleotide
uggugagcuuaaugaaugatt

SEQ ID NO: 325 - DNA, 21 bp, Artificial Sequence
  Description of Artificial Sequence: Synthetic oligonucleotide
  Description of Combined DNA/RNA Molecule: Synthetic oligonucleotide
agaggacauugagguguautt

SEQ ID NO: 326 - DNA, 23 bp, Artificial Sequence
  Description of Artificial Sequence: Synthetic oligonucleotide
  Description of Combined DNA/RNA Molecule: Synthetic oligonucleotide
aactgctcaacaccggaattttt

SEQ ID NO: 327 - RNA, 22 nt, Artificial Sequence
  Description of Artificial Sequence: Synthetic oligonucleotide
ccauccuguacaacuucaugug

SEQ ID NO: 328 - DNA, 21 bp, Artificial Sequence
  Description of Artificial Sequence: Synthetic oligonucleotide
  Description of Combined DNA/RNA Molecule: Synthetic oligonucleotide
caauaaggaagaagcccuutt

SEQ ID NO: 329 - DNA, 21 bp, Artificial Sequence
  Description of Artificial Sequence: Synthetic oligonucleotide
  Description of Combined DNA/RNA Molecule: Synthetic oligonucleotide
ttauuccuucuucgggaaguc

SEQ ID NO: 330 - DNA, 21 bp, Artificial Sequence
  Description of Artificial Sequence: Synthetic oligonucleotide
  Description of Combined DNA/RNA Molecule: Synthetic oligonucleotide
ggcuggcuucauccacugctt

SEQ ID NO: 331 - DNA, 19 bp, Artificial Sequence
  Description of Artificial Sequence: Synthetic oligonucleotide
cgaagatgttgacctggtc

SEQ ID NO: 332 - DNA, 19 bp, Artificial Sequence
  Description of Artificial Sequence: Synthetic oligonucleotide
agagttgtcctgtagttcg

SEQ ID NO: 333 - DNA, 21 bp, Artificial Sequence
  Description of Artificial Sequence: Synthetic oligonucleotide
  Description of Combined DNA/RNA Molecule: Synthetic oligonucleotide
ggaaauaugggaaagaucctt

SEQ ID NO: 334 - DNA, 23 bp, Artificial Sequence
  Description of Artificial Sequence: Synthetic oligonucleotide
  Description of Combined DNA/RNA Molecule: Synthetic oligonucleotide
ggagacuuucaaauacauctttt

SEQ ID NO: 335 - DNA, 21 bp, Artificial Sequence
  Description of Artificial Sequence: Synthetic oligonucleotide
aaccttctggaacccgcccac

SEQ ID NO: 336 - DNA, 21 bp, Artificial Sequence
  Description of Artificial Sequence: Synthetic oligonucleotide
aatgttgcagaggggaaggag

SEQ ID NO: 337 - DNA, 21 bp, Artificial Sequence
  Description of Artificial Sequence: Synthetic oligonucleotide
aagagaatggagcacatgaaa

SEQ ID NO: 338 - DNA, 21 bp, Artificial Sequence
  Description of Artificial Sequence: Synthetic oligonucleotide
aagatgagcataaccagtgac

SEQ ID NO: 339 - DNA, 21 bp, Artificial Sequence
  Description of Artificial Sequence: Synthetic oligonucleotide
aaggccctatatttgcattaa

SEQ ID NO: 340 - DNA, 23 bp, Artificial Sequence
  Description of Artificial Sequence: Synthetic oligonucleotide
gttggctgagtgctatgggctga

SEQ ID NO: 341 - DNA, 22 bp, Artificial Sequence
  Description of Artificial Sequence: Synthetic oligonucleotide
gggcttatggaggaccctatga

SEQ ID NO: 342 - DNA, 52 bp, Artificial Sequence
  Description of Artificial Sequence: Synthetic oligonucleotide
ggaacagcagagaagctcattcaagagatgagcttctctgctgttccttttt

SEQ ID NO: 343 - DNA, 51 bp, Artificial Sequence
  Description of Artificial Sequence: Synthetic oligonucleotide
caccgaagcagcacgacttcttcttcaagagagaagaagtcgtgctgcttc

SEQ ID NO: 344 - DNA, 22 bp, Artificial Sequence
  Description of Artificial Sequence: Synthetic oligonucleotide
  Description of Combined DNA/RNA Molecule: Synthetic oligonucleotide
agguucagcagcuccacggatt

SEQ ID NO: 345 - DNA, 64 bp, Artificial Sequence
  Description of Artificial Sequence: Synthetic oligonucleotide
gatcccccctcggggatactgtctgattcaagagatcagacagtatccccgaggtttttggaaa

SEQ ID NO: 346 - DNA, 19 bp, Artificial Sequence
  Description of Artificial Sequence: Synthetic oligonucleotide
gagcatcttcgagcaagaa

SEQ ID NO: 347 - DNA, 19 bp, Artificial Sequence
  Description of Artificial Sequence: Synthetic oligonucleotide
catgtggcaccgtttgcct

SEQ ID NO: 348 - RNA, 19 nt, Artificial Sequence
  Description of Artificial Sequence: Synthetic oligonucleotide
uggcuuaucuuacacugga

SEQ ID NO: 349 - RNA, 25 nt, Artificial Sequence
  Description of Artificial Sequence: Synthetic oligonucleotide
ggcucaaguucaggagugagaacaa

SEQ ID NO: 350 - RNA, 25 nt, Artificial Sequence
  Description of Artificial Sequence: Synthetic oligonucleotide
ggaacgacuucaaagagaacuugag

SEQ ID NO: 351 - RNA, 25 nt, Artificial Sequence
  Description of Artificial Sequence: Synthetic oligonucleotide
gcauuacaaccagacaguugauauu

SEQ ID NO: 352 - DNA, 21 bp, Artificial Sequence
  Description of Artificial Sequence: Synthetic oligonucleotide
  Description of Combined DNA/RNA Molecule: Synthetic oligonucleotide
guggagcagcggcaaaauctt

SEQ ID NO: 353 - DNA, 21 bp, Artificial Sequence
  Description of Artificial Sequence: Synthetic oligonucleotide
  Description of Combined DNA/RNA Molecule: Synthetic oligonucleotide
uccucauuugaggaauaaatt

SEQ ID NO: 354 - DNA, 21 bp, Artificial Sequence
  Description of Artificial Sequence: Synthetic oligonucleotide
  Description of Combined DNA/RNA Molecule: Synthetic oligonucleotide
ggaauaaaccuugugcagutt

SEQ ID NO: 355 - DNA, 21 bp, Artificial Sequence
  Description of Artificial Sequence: Synthetic oligonucleotide
  Description of Combined DNA/RNA Molecule: Synthetic oligonucleotide
uaaaccuugugcaguuguatt

SEQ ID NO: 356 - DNA, 21 bp, Artificial Sequence
  Description of Artificial Sequence: Synthetic oligonucleotide
  Description of Combined DNA/RNA Molecule: Synthetic oligonucleotide
ccuugugcaguuguacagutt

SEQ ID NO: 357 - RNA, 21 nt, Artificial Sequence
  Description of Artificial Sequence: Synthetic oligonucleotide
ccggcaaccucgcggccaauu

SEQ ID NO: 358 - RNA, 21 nt, Artificial Sequence
  Description of Artificial Sequence: Synthetic oligonucleotide
cgacuaccaucugcacuuauu

SEQ ID NO: 359 - DNA, 21 bp, Artificial Sequence
  Description of Artificial Sequence: Synthetic oligonucleotide
aaccggctctccattggcatt

SEQ ID NO: 360 - DNA, 21 bp, Artificial Sequence
  Description of Artificial Sequence: Synthetic oligonucleotide
gtggttggaaatggcaccttt

SEQ ID NO: 361 - RNA, 21 nt, Artificial Sequence
  Description of Artificial Sequence: Synthetic oligonucleotide
aagcgaccaggauuauauucu

SEQ ID NO: 362 - RNA, 21 nt, Artificial Sequence
  Description of Artificial Sequence: Synthetic oligonucleotide
aagugagguggaaaggcguuu

SEQ ID NO: 363 - DNA, 55 bp, Artificial Sequence
  Description of Artificial Sequence: Synthetic oligonucleotide
tcccatgtccacttcgactatgatgtcaagagcatcatagtcgaagtggacattt

SEQ ID NO: 364 - DNA, 51 bp, Artificial Sequence
  Description of Artificial Sequence: Synthetic oligonucleotide
tcccagatctacttcttccgaggtcaagagcctcggaagaagtagatcttt

SEQ ID NO: 365 - DNA, 55 bp, Artificial Sequence
  Description of Artificial Sequence: Synthetic oligonucleotide
tcccaggatgctgatggctatgccttcaagagaggcatagccatcagcatccttt

SEQ ID NO: 366 - DNA, 21 bp, Artificial Sequence
  Description of Artificial Sequence: Synthetic oligonucleotide
  Description of Combined DNA/RNA Molecule: Synthetic oligonucleotide
aatgcccatctctataggttt

SEQ ID NO: 367 - DNA, 21 bp, Artificial Sequence
  Description of Artificial Sequence: Synthetic oligonucleotide
  Description of Combined DNA/RNA Molecule: Synthetic oligonucleotide
ggauaugcgaagaaagauctt

SEQ ID NO: 368 - DNA, 21 bp, Artificial Sequence
  Description of Artificial Sequence: Synthetic oligonucleotide
aaggaggaagctgatgagaac

SEQ ID NO: 369 - DNA, 21 bp, Artificial Sequence
  Description of Artificial Sequence: Synthetic oligonucleotide
aacgtccggaacaaactgaag

SEQ ID NO: 370 - DNA, 21 bp, Artificial Sequence
  Description of Artificial Sequence: Synthetic oligonucleotide
aagtggtacgcagattgcacg

SEQ ID NO: 371 - DNA, 21 bp, Artificial Sequence
  Description of Artificial Sequence: Synthetic oligonucleotide
aaggagaagaaaaagaaggac

SEQ ID NO: 372 - DNA, 19 bp, Artificial Sequence
  Description of Artificial Sequence: Synthetic oligonucleotide
gcaggtagagttggctttg

SEQ ID NO: 373 - DNA, 19 bp, Artificial Sequence
  Description of Artificial Sequence: Synthetic oligonucleotide
gactatgatcgactgcggc

SEQ ID NO: 374 - DNA, 19 bp, Artificial Sequence
  Description of Artificial Sequence: Synthetic oligonucleotide
gtgagaacgatgagaaata

SEQ ID NO: 375 - DNA, 19 bp, Artificial Sequence
  Description of Artificial Sequence: Synthetic oligonucleotide
gttggtgcctaatcactta

SEQ ID NO: 376 - DNA, 19 bp, Artificial Sequence
  Description of Artificial Sequence: Synthetic oligonucleotide
gacgtgtcaggaccttcgt

SEQ ID NO: 377 - DNA, 19 bp, Artificial Sequence
  Description of Artificial Sequence: Synthetic oligonucleotide
cttaactggtgtacattaa

SEQ ID NO: 378 - RNA, 23 nt, Artificial Sequence
  Description of Artificial Sequence: Synthetic oligonucleotide
caauaugaucauccaguccauua

SEQ ID NO: 379 - RNA, 23 nt, Artificial Sequence
  Description of Artificial Sequence: Synthetic oligonucleotide
caagcaugcagcuucuaccguuc

SEQ ID NO: 380 - RNA, 23 nt, Artificial Sequence
  Description of Artificial Sequence: Synthetic oligonucleotide
cagucgaguucucccaccgcucu

SEQ ID NO: 381 - RNA, 23 nt, Artificial Sequence
  Description of Artificial Sequence: Synthetic oligonucleotide
gagaccaucuacgaccugggcac

SEQ ID NO: 382 - RNA, 23 nt, Artificial Sequence
  Description of Artificial Sequence: Synthetic oligonucleotide
gagagugacauggcgccuguccu

SEQ ID NO: 383 - RNA, 23 nt, Artificial Sequence
  Description of Artificial Sequence: Synthetic oligonucleotide
aaggaaccaaacaguugaaacug

SEQ ID NO: 384 - RNA, 23 nt, Artificial Sequence
  Description of Artificial Sequence: Synthetic oligonucleotide
gagucuucuaucgcucccaucgu

SEQ ID NO: 385 - RNA, 23 nt, Artificial Sequence
  Description of Artificial Sequence: Synthetic oligonucleotide
aaauugagguggauucacgaguu

SEQ ID NO: 386 - RNA, 23 nt, Artificial Sequence
  Description of Artificial Sequence: Synthetic oligonucleotide
uaguaucagcgaggaacaaauua

SEQ ID NO: 387 - RNA, 23 nt, Artificial Sequence
  Description of Artificial Sequence: Synthetic oligonucleotide
aagaguauauagcacaggauuua

SEQ ID NO: 388 - RNA, 23 nt, Artificial Sequence
  Description of Artificial Sequence: Synthetic oligonucleotide
aagauugcccuugcucgcaauaa

SEQ ID NO: 389 - RNA, 23 nt, Artificial Sequence
  Description of Artificial Sequence: Synthetic oligonucleotide
uaucaccguaugaaauggaaacu

SEQ ID NO: 390 - RNA, 23 nt, Artificial Sequence
  Description of Artificial Sequence: Synthetic oligonucleotide
aaguggaauggguaacucuucuu

SEQ ID NO: 391 - RNA, 23 nt, Artificial Sequence
  Description of Artificial Sequence: Synthetic oligonucleotide
aacggccgucccaaagcuggcug

SEQ ID NO: 392 - RNA, 23 nt, Artificial Sequence
  Description of Artificial Sequence: Synthetic oligonucleotide
aagaaacagauucugcgcuugau

SEQ ID NO: 393 - RNA, 23 nt, Artificial Sequence
  Description of Artificial Sequence: Synthetic oligonucleotide
gaauuagguccacuucaaugucc

SEQ ID NO: 394 - RNA, 23 nt, Artificial Sequence
  Description of Artificial Sequence: Synthetic oligonucleotide
aagauucuuccauuaaauugccu

SEQ ID NO: 395 - DNA, 21 bp, Artificial Sequence
  Description of Artificial Sequence: Synthetic oligonucleotide
aactaccagaaaggtatacct

SEQ ID NO: 396 - DNA, 21 bp, Artificial Sequence
  Description of Artificial Sequence: Synthetic oligonucleotide
aagacccttgtgctcgttgtc

SEQ ID NO: 397 - DNA, 21 bp, Artificial Sequence
  Description of Artificial Sequence: Synthetic oligonucleotide
aagcagagtgacctggtagat

SEQ ID NO: 398 - DNA, 21 bp, Artificial Sequence
  Description of Artificial Sequence: Synthetic oligonucleotide
  Description of Combined DNA/RNA Molecule: Synthetic oligonucleotide
ucacaguguccuuuauguatt

SEQ ID NO: 399 - DNA, 21 bp, Artificial Sequence
  Description of Artificial Sequence: Synthetic oligonucleotide
  Description of Combined DNA/RNA Molecule: Synthetic oligonucleotide
auggcuucgacgaguucaatt

SEQ ID NO: 400 - DNA, 21 bp, Artificial Sequence
  Description of Artificial Sequence: Synthetic oligonucleotide
  Description of Combined DNA/RNA Molecule: Synthetic oligonucleotide
gcaugaaccggaggcccautt

SEQ ID NO: 401 - DNA, 21 bp, Artificial Sequence
  Description of Artificial Sequence: Synthetic oligonucleotide
agaccagagcaggaacaagtt

SEQ ID NO: 402 - DNA, 19 bp, Artificial Sequence
  Description of Artificial Sequence: Synthetic oligonucleotide
gaagatttgcgcagtggac

SEQ ID NO: 403 - RNA, 21 nt, Artificial Sequence
  Description of Artificial Sequence: Synthetic oligonucleotide
ugguucacugaagacccaguu

SEQ ID NO: 404 - DNA, 21 bp, Artificial Sequence
  Description of Artificial Sequence: Synthetic oligonucleotide
  Description of Combined DNA/RNA Molecule: Synthetic oligonucleotide
auuccugcucaauggauuutt

SEQ ID NO: 405 - DNA, 23 bp, Artificial Sequence
  Description of Artificial Sequence: Synthetic oligonucleotide
tagagcctggctgggttgttttg

SEQ ID NO: 406 - DNA, 21 bp, Artificial Sequence
  Description of Artificial Sequence: Synthetic oligonucleotide
aaccacaacacaaagtcacag

SEQ ID NO: 407 - RNA, 22 nt, Artificial Sequence
  Description of Artificial Sequence: Synthetic oligonucleotide
aaaccggcaggaguuuacccag

SEQ ID NO: 408 - RNA, 21 nt, Artificial Sequence
  Description of Artificial Sequence: Synthetic oligonucleotide
aagguggccauuaaggugauu

SEQ ID NO: 409 - RNA, 19 nt, Artificial Sequence
  Description of Artificial Sequence: Synthetic oligonucleotide
ucagaagaccacaaucuac

SEQ ID NO: 410 - DNA, 21 bp, Artificial Sequence
  Description of Artificial Sequence: Synthetic oligonucleotide
  Description of Combined DNA/RNA Molecule: Synthetic oligonucleotide
gugaagucaacaugccugctt

SEQ ID NO: 411 - DNA, 21 bp, Artificial Sequence
  Description of Artificial Sequence: Synthetic oligonucleotide
  Description of Combined DNA/RNA Molecule: Synthetic oligonucleotide
cacccuacacgaagccagatt

SEQ ID NO: 412 - DNA, 21 bp, Artificial Sequence
  Description of Artificial Sequence: Synthetic oligonucleotide
  Description of Combined DNA/RNA Molecule: Synthetic oligonucleotide
ggacagaugaagcugcuuutt

SEQ ID NO: 413 - DNA, 20 bp, Artificial Sequence
  Description of Artificial Sequence: Synthetic oligonucleotide
ggtggacaagaatgctagac

SEQ ID NO: 414 - DNA, 20 bp, Artificial Sequence
  Description of Artificial Sequence: Synthetic oligonucleotide
gaaggattgaccagttaacc

SEQ ID NO: 415 - DNA, 20 bp, Artificial Sequence
  Description of Artificial Sequence: Synthetic oligonucleotide
gcttgaacatgagcaagagc

SEQ ID NO: 416 - DNA, 21 bp, Artificial Sequence
  Description of Artificial Sequence: Synthetic oligonucleotide
aacttccggcagaaacttctg

SEQ ID NO: 417 - DNA, 21 bp, Artificial Sequence
  Description of Artificial Sequence: Synthetic oligonucleotide
  Description of Combined DNA/RNA Molecule: Synthetic oligonucleotide
gccacagcauacauccugutt

SEQ ID NO: 418 - DNA, 21 bp, Artificial Sequence
  Description of Artificial Sequence: Synthetic oligonucleotide
  Description of Combined DNA/RNA Molecule: Synthetic oligonucleotide
cgcacgcuaaugcuggcautt

SEQ ID NO: 419 - DNA, 23 bp, Artificial Sequence
  Description of Artificial Sequence: Synthetic oligonucleotide
  Description of Combined DNA/RNA Molecule: Synthetic oligonucleotide
aagcgguguuucucagaattgtt

SEQ ID NO: 420 - DNA, 21 bp, Artificial Sequence
  Description of Artificial Sequence: Synthetic oligonucleotide
  Description of Combined DNA/RNA Molecule: Synthetic oligonucleotide
gucggagggaagacagugctt

SEQ ID NO: 421 - DNA, 21 bp, Artificial Sequence
  Description of Artificial Sequence: Synthetic oligonucleotide
  Description of Combined DNA/RNA Molecule: Synthetic oligonucleotide
gcaugugauugcugacgcctt

SEQ ID NO: 422 - DNA, 21 bp, Artificial Sequence
  Description of Artificial Sequence: Synthetic oligonucleotide
aaggcttcccaactgatgcaa

SEQ ID NO: 423 - DNA, 21 bp, Artificial Sequence
  Description of Artificial Sequence: Synthetic oligonucleotide
aagccaaggaagcattgggta

SEQ ID NO: 424 - DNA, 21 bp, Artificial Sequence
  Description of Artificial Sequence: Synthetic oligonucleotide
aagtactagaaggagaggtgg

SEQ ID NO: 425 - DNA, 21 bp, Artificial Sequence
  Description of Artificial Sequence: Synthetic oligonucleotide
gttcaaaagctggatgatctt

SEQ ID NO: 426 - DNA, 21 bp, Artificial Sequence
  Description of Artificial Sequence: Synthetic oligonucleotide
aagatacggtccagaagctta

SEQ ID NO: 427 - DNA, 21 bp, Artificial Sequence
  Description of Artificial Sequence: Synthetic oligonucleotide
ccagcggctcaaggaggtttt

SEQ ID NO: 428 - DNA, 21 bp, Artificial Sequence
  Description of Artificial Sequence: Synthetic oligonucleotide
gagtcgggaccacagtttatt

SEQ ID NO: 429 - DNA, 21 bp, Artificial Sequence
  Description of Artificial Sequence: Synthetic oligonucleotide
taggctaattgtactgctctt

SEQ ID NO: 430 - DNA, 21 bp, Artificial Sequence
  Description of Artificial Sequence: Synthetic oligonucleotide
ggagatcctctacaaagggtt

SEQ ID NO: 431 - DNA, 21 bp, Artificial Sequence
  Description of Artificial Sequence: Synthetic oligonucleotide
aagagatgctaatagcagttt

SEQ ID NO: 432 - DNA, 21 bp, Artificial Sequence
  Description of Artificial Sequence: Synthetic oligonucleotide
actcttactgctctccagttt

SEQ ID NO: 433 - DNA, 21 bp, Artificial Sequence
  Description of Artificial Sequence: Synthetic oligonucleotide
cgagacctatcgccgcatcgt

SEQ ID NO: 434 - DNA, 21 bp, Artificial Sequence
  Description of Artificial Sequence: Synthetic oligonucleotide
gggcggctttgccaagtgctt

SEQ ID NO: 435 - DNA, 21 bp, Artificial Sequence
  Description of Artificial Sequence: Synthetic oligonucleotide
  Description of Combined DNA/RNA Molecule: Synthetic oligonucleotide
cccugagaucccagcgcugtt

SEQ ID NO: 436 - DNA, 19 bp, Artificial Sequence
  Description of Artificial Sequence: Synthetic oligonucleotide
gatcaatggctacacagga

SEQ ID NO: 437 - DNA, 21 bp, Artificial Sequence
  Description of Artificial Sequence: Synthetic oligonucleotide
  Description of Combined DNA/RNA Molecule: Synthetic oligonucleotide
accugucgaggacuucauctt

SEQ ID NO: 438 - DNA, 21 bp, Artificial Sequence
  Description of Artificial Sequence: Synthetic oligonucleotide
  Description of Combined DNA/RNA Molecule: Synthetic oligonucleotide
guacaagguggagcgcaactt

SEQ ID NO: 439 - DNA, 19 bp, Artificial Sequence
  Description of Artificial Sequence: Synthetic oligonucleotide
cccggaaatttcccgtccc

SEQ ID NO: 440 - DNA, 19 bp, Artificial Sequence
  Description of Artificial Sequence: Synthetic oligonucleotide
gagatgacctgcattgccc

SEQ ID NO: 441 - DNA, 21 bp, Artificial Sequence
  Description of Artificial Sequence: Synthetic oligonucleotide
  Description of Combined DNA/RNA Molecule: Synthetic oligonucleotide
acucuugguucagaaaggatt

SEQ ID NO: 442 - DNA, 19 bp, Artificial Sequence
  Description of Artificial Sequence: Synthetic oligonucleotide
ggttcactactagtaaact

SEQ ID NO: 443 - DNA, 19 bp, Artificial Sequence
  Description of Artificial Sequence: Synthetic oligonucleotide
ggaatctactcgtttgtat

SEQ ID NO: 444 - DNA, 21 bp, Artificial Sequence
  Description of Artificial Sequence: Synthetic oligonucleotide
ccaagaaccagagaaaagatt

SEQ ID NO: 445 - DNA, 21 bp, Artificial Sequence
  Description of Artificial Sequence: Synthetic oligonucleotide
  Description of Combined DNA/RNA Molecule: Synthetic oligonucleotide
cucuuuagaaacugggcaatt

SEQ ID NO: 446 - DNA, 21 bp, Artificial Sequence
  Description of Artificial Sequence: Synthetic oligonucleotide
aagactccagtggtaatctac

SEQ ID NO: 447 - DNA, 19 bp, Artificial Sequence
  Description of Artificial Sequence: Synthetic oligonucleotide
tagagctacagaacgaaag

SEQ ID NO: 448 - DNA, 19 bp, Artificial Sequence
  Description of Artificial Sequence: Synthetic oligonucleotide
gaatgtgaacaccaccaaa

SEQ ID NO: 449 - DNA, 19 bp, Artificial Sequence
  Description of Artificial Sequence: Synthetic oligonucleotide
ctacacaaatattgaggat

SEQ ID NO: 450 - DNA, 19 bp, Artificial Sequence
  Description of Artificial Sequence: Synthetic oligonucleotide
ctgtacttccatacttgat

SEQ ID NO: 451 - DNA, 21 bp, Artificial Sequence
  Description of Artificial Sequence: Synthetic oligonucleotide
aagccaagacaaattctgtgt

SEQ ID NO: 452 - DNA, 21 bp, Artificial Sequence
  Description of Artificial Sequence: Synthetic oligonucleotide
aacctccgtgatgttgcttga

SEQ ID NO: 453 - DNA, 19 bp, Artificial Sequence
  Description of Artificial Sequence: Synthetic oligonucleotide
caaagccagaaacaagttg

SEQ ID NO: 454 - DNA, 19 bp, Artificial Sequence
  Description of Artificial Sequence: Synthetic oligonucleotide
aaataaactctacctggtt

SEQ ID NO: 455 - DNA, 19 bp, Artificial Sequence
  Description of Artificial Sequence: Synthetic oligonucleotide
aaacctcagaatctgctta

SEQ ID NO: 456 - DNA, 19 bp, Artificial Sequence
  Description of Artificial Sequence: Synthetic oligonucleotide
gttacttctatgcctgatt

SEQ ID NO: 457 - DNA, 23 bp, Artificial Sequence
  Description of Artificial Sequence: Synthetic oligonucleotide
  Description of Combined DNA/RNA Molecule: Synthetic oligonucleotide
gaccgagaagguagacaauugtt

SEQ ID NO: 458 - DNA, 23 bp, Artificial Sequence
  Description of Artificial Sequence: Synthetic oligonucleotide
  Description of Combined DNA/RNA Molecule: Synthetic oligonucleotide
aagaggcacaaggtccacatctt

SEQ ID NO: 459 - DNA, 21 bp, Artificial Sequence
  Description of Artificial Sequence: Synthetic oligonucleotide
  Description of Combined DNA/RNA Molecule: Synthetic oligonucleotide
augcagcuggagauggcactt

SEQ ID NO: 460 - DNA, 21 bp, Artificial Sequence
  Description of Artificial Sequence: Synthetic oligonucleotide
  Description of Combined DNA/RNA Molecule: Synthetic oligonucleotide
aggaaguuggaaggauccatt

SEQ ID NO: 461 - RNA, 21 nt, Artificial Sequence
  Description of Artificial Sequence: Synthetic oligonucleotide
gaacacuuaucaagccuaauu

SEQ ID NO: 462 - RNA, 21 nt, Artificial Sequence
  Description of Artificial Sequence: Synthetic oligonucleotide
ggagagaacaagcauauuuuu

SEQ ID NO: 463 - RNA, 21 nt, Artificial Sequence
  Description of Artificial Sequence: Synthetic oligonucleotide
ugauguaccuauucucuuauu

SEQ ID NO: 464 - RNA, 21 nt, Artificial Sequence
  Description of Artificial Sequence: Synthetic oligonucleotide
gauaagagauuucagaagauu

SEQ ID NO: 465 - DNA, 21 bp, Artificial Sequence
  Description of Artificial Sequence: Synthetic oligonucleotide
  Description of Combined DNA/RNA Molecule: Synthetic oligonucleotide
gucaccacagcgcaatggatt

SEQ ID NO: 466 - DNA, 21 bp, Artificial Sequence
  Description of Artificial Sequence: Synthetic oligonucleotide
  Description of Combined DNA/RNA Molecule: Synthetic oligonucleotide
acucuagaugcucagacuutt

SEQ ID NO: 467 - DNA, 21 bp, Artificial Sequence
  Description of Artificial Sequence: Synthetic oligonucleotide
aggatccatcttcctggttac

SEQ ID NO: 468 - DNA, 21 bp, Artificial Sequence
  Description of Artificial Sequence: Synthetic oligonucleotide
  Description of Combined DNA/RNA Molecule: Synthetic oligonucleotide
uaacaccagtacggacgggtt

SEQ ID NO: 469 - RNA, 19 nt, Artificial Sequence
  Description of Artificial Sequence: Synthetic oligonucleotide
ugcuccucucaugugggau

SEQ ID NO: 470 - RNA, 19 nt, Artificial Sequence
  Description of Artificial Sequence: Synthetic oligonucleotide
ucauuggucaguugucauc

SEQ ID NO: 471 - RNA, 19 nt, Artificial Sequence
  Description of Artificial Sequence: Synthetic oligonucleotide
gagacuugggcggucaaau

SEQ ID NO: 472 - RNA, 19 nt, Artificial Sequence
  Description of Artificial Sequence: Synthetic oligonucleotide
cggugacacucaguauguc

SEQ ID NO: 473 - RNA, 21 nt, Artificial Sequence
  Description of Artificial Sequence: Synthetic oligonucleotide
aagcaugaccagccugcuuac

SEQ ID NO: 474 - DNA, 21 bp, Artificial Sequence
  Description of Artificial Sequence: Synthetic oligonucleotide
  Description of Combined DNA/RNA Molecule: Synthetic oligonucleotide
gguuguccuugaguaauaatt

SEQ ID NO: 475 - RNA, 21 nt, Artificial Sequence
  Description of Artificial Sequence: Synthetic oligonucleotide
gucugguacgacuggaguacc

SEQ ID NO: 476 - DNA, 21 bp, Artificial Sequence
  Description of Artificial Sequence: Synthetic oligonucleotide
aacattcactggtgcaactgc

SEQ ID NO: 477 - DNA, 21 bp, Artificial Sequence
  Description of Artificial Sequence: Synthetic oligonucleotide
aacaacatcttcctacatgag

SEQ ID NO: 478 - DNA, 21 bp, Artificial Sequence
  Description of Artificial Sequence: Synthetic oligonucleotide
aaagaattggatctggatcat

SEQ ID NO: 479 - RNA, 21 nt, Artificial Sequence
  Description of Artificial Sequence: Synthetic oligonucleotide
aauaguucagcaguuuggcua

SEQ ID NO: 480 - DNA, 21 bp, Artificial Sequence
  Description of Artificial Sequence: Synthetic oligonucleotide
gaatttaaaaccagaattatc

SEQ ID NO: 481 - DNA, 21 bp, Artificial Sequence
  Description of Artificial Sequence: Synthetic oligonucleotide
aagcgaagcagtggttcaggt

SEQ ID NO: 482 - RNA, 21 nt, Artificial Sequence
  Description of Artificial Sequence: Synthetic oligonucleotide
agacgagcugagcgagaagca

SEQ ID NO: 483 - DNA, 21 bp, Artificial Sequence
  Description of Artificial Sequence: Synthetic oligonucleotide
  Description of Combined DNA/RNA Molecule: Synthetic oligonucleotide
caucuacaagcccaacaactt

SEQ ID NO: 484 - RNA, 19 nt, Artificial Sequence
  Description of Artificial Sequence: Synthetic oligonucleotide
cuucgacuuugucaccgag

SEQ ID NO: 485 - DNA, 21 bp, Artificial Sequence
  Description of Artificial Sequence: Synthetic oligonucleotide
aacctgtctccacaaagtgtg

SEQ ID NO: 486 - DNA, 21 bp, Artificial Sequence
  Description of Artificial Sequence: Synthetic oligonucleotide
  Description of Combined DNA/RNA Molecule: Synthetic oligonucleotide
caacaagaagacgcgaauctt

SEQ ID NO: 487 - RNA, 21 nt, Artificial Sequence
  Description of Artificial Sequence: Synthetic oligonucleotide
aaucgccuaggaagacugauc

SEQ ID NO: 488 - RNA, 21 nt, Artificial Sequence
  Description of Artificial Sequence: Synthetic oligonucleotide
ccccuguagcggccaaacauu

SEQ ID NO: 489 - RNA, 21 nt, Artificial Sequence
  Description of Artificial Sequence: Synthetic oligonucleotide
caaaguacaaaggaauuuauu

SEQ ID NO: 490 - RNA, 21 nt, Artificial Sequence
  Description of Artificial Sequence: Synthetic oligonucleotide
cgggagggacagacuuucuuu

SEQ ID NO: 491 - DNA, 21 bp, Artificial Sequence
  Description of Artificial Sequence: Synthetic oligonucleotide
gtgaaccacaactccgtattc

SEQ ID NO: 492 - RNA, 21 nt, Artificial Sequence
  Description of Artificial Sequence: Synthetic oligonucleotide
aacugguugacgaaaguggug

SEQ ID NO: 493 - RNA, 21 nt, Artificial Sequence
  Description of Artificial Sequence: Synthetic oligonucleotide
aacccgcguuggcgugguuga

SEQ ID NO: 494 - DNA, 21 bp, Artificial Sequence
  Description of Artificial Sequence: Synthetic oligonucleotide
  Description of Combined DNA/RNA Molecule: Synthetic oligonucleotide
accaauccagcacccaucctt

SEQ ID NO: 495 - DNA, 21 bp, Artificial Sequence
  Description of Artificial Sequence: Synthetic oligonucleotide
  Description of Combined DNA/RNA Molecule: Synthetic oligonucleotide
cugaugaccagcaacuugatt

SEQ ID NO: 496 - DNA, 21 bp, Artificial Sequence
  Description of Artificial Sequence: Synthetic oligonucleotide
  Description of Combined DNA/RNA Molecule: Synthetic oligonucleotide
gagcugcaaggccuugccctt

SEQ ID NO: 497 - DNA, 26 bp, Artificial Sequence
  Description of Artificial Sequence: Synthetic oligonucleotide
ctcctccattgtggaacccaaggagc

SEQ ID NO: 498 - RNA, 21 nt, Artificial Sequence
  Description of Artificial Sequence: Synthetic oligonucleotide
guauggacacugacucagauu

SEQ ID NO: 499 - RNA, 21 nt, Artificial Sequence
  Description of Artificial Sequence: Synthetic oligonucleotide
guacuuccagcuagauguuuu

SEQ ID NO: 500 - RNA, 19 nt, Artificial Sequence
  Description of Artificial Sequence: Synthetic oligonucleotide
gagcgaaaccugcucucag

SEQ ID NO: 501 - RNA, 19 nt, Artificial Sequence
  Description of Artificial Sequence: Synthetic oligonucleotide
gggugacuacuaccgcuac

SEQ ID NO: 502 - RNA, 19 nt, Artificial Sequence
  Description of Artificial Sequence: Synthetic oligonucleotide
agacagcacccucaucaug

SEQ ID NO: 503 - DNA, 21 bp, Artificial Sequence
  Description of Artificial Sequence: Synthetic oligonucleotide
  Description of Combined DNA/RNA Molecule: Synthetic oligonucleotide
guccugguggcgaguucgatt

SEQ ID NO: 504 - DNA, 21 bp, Artificial Sequence
  Description of Artificial Sequence: Synthetic oligonucleotide
  Description of Combined DNA/RNA Molecule: Synthetic oligonucleotide
cgucucuaugaccucaacatt

SEQ ID NO: 505 - RNA, 21 nt, Artificial Sequence
  Description of Artificial Sequence: Synthetic oligonucleotide
augaagagucuuccaauccuu

SEQ ID NO: 506 - DNA, 21 bp, Artificial Sequence
  Description of Artificial Sequence: Synthetic oligonucleotide
aaggtccacttcgtatgctgg

SEQ ID NO: 507 - DNA, 21 bp, Artificial Sequence
  Description of Artificial Sequence: Synthetic oligonucleotide
aagggcaagtttcccgtgcag

SEQ ID NO: 508 - DNA, 21 bp, Artificial Sequence
  Description of Artificial Sequence: Synthetic oligonucleotide
aagaaggcagatgaggggtta

SEQ ID NO: 509 - RNA, 21 nt, Artificial Sequence
  Description of Artificial Sequence: Synthetic oligonucleotide
aaucaaaggcuaugucuggcg

SEQ ID NO: 510 - RNA, 21 nt, Artificial Sequence
  Description of Artificial Sequence: Synthetic oligonucleotide
aaggacuacgccgacucuauu

SEQ ID NO: 511 - DNA, 21 bp, Artificial Sequence
  Description of Artificial Sequence: Synthetic oligonucleotide
cgcctctttcccagtccatgt

SEQ ID NO: 512 - DNA, 21 bp, Artificial Sequence
  Description of Artificial Sequence: Synthetic oligonucleotide
gagctgagtgctcaggctaaa

SEQ ID NO: 513 - DNA, 21 bp, Artificial Sequence
  Description of Artificial Sequence: Synthetic oligonucleotide
  Description of Combined DNA/RNA Molecule: Synthetic oligonucleotide
aguggcccguuuccagcggtt

SEQ ID NO: 514 - DNA, 21 bp, Artificial Sequence
  Description of Artificial Sequence: Synthetic oligonucleotide
aaggtgattggtagaggtgca

SEQ ID NO: 515 - DNA, 21 bp, Artificial Sequence
  Description of Artificial Sequence: Synthetic oligonucleotide
aagcacaaaagcttgtctcca

SEQ ID NO: 516 - RNA, 19 nt, Artificial Sequence
  Description of Artificial Sequence: Synthetic oligonucleotide
ggaauucauggccuuuguu

SEQ ID NO: 517 - DNA, 21 bp, Artificial Sequence
  Description of Artificial Sequence: Synthetic oligonucleotide
  Description of Combined DNA/RNA Molecule: Synthetic oligonucleotide
gaucucaaguuucaacacctt

SEQ ID NO: 518 - DNA, 21 bp, Artificial Sequence
  Description of Artificial Sequence: Synthetic oligonucleotide
  Description of Combined DNA/RNA Molecule: Synthetic oligonucleotide
gucuguaaagaccaagggatt

SEQ ID NO: 519 - DNA, 21 bp, Artificial Sequence
  Description of Artificial Sequence: Synthetic oligonucleotide
  Description of Combined DNA/RNA Molecule: Synthetic oligonucleotide
ggagcaaguaguggggcugtt

SEQ ID NO: 520 - DNA, 21 bp, Artificial Sequence
  Description of Artificial Sequence: Synthetic oligonucleotide
  Description of Combined DNA/RNA Molecule: Synthetic oligonucleotide
guacauccauuauaagcugtt

SEQ ID NO: 521 - DNA, 23 bp, Artificial Sequence
  Description of Artificial Sequence: Synthetic oligonucleotide
aacttccagctggcatataggtt

SEQ ID NO: 522 - DNA, 23 bp, Artificial Sequence
  Description of Artificial Sequence: Synthetic oligonucleotide
  Description of Combined DNA/RNA Molecule: Synthetic oligonucleotide
aagggucaugcucuaucagautt

SEQ ID NO: 523 - DNA, 23 bp, Artificial Sequence
  Description of Artificial Sequence: Synthetic oligonucleotide
  Description of Combined DNA/RNA Molecule: Synthetic oligonucleotide
aagaagacaucauccggaauatt

SEQ ID NO: 524 - DNA, 23 bp, Artificial Sequence
  Description of Artificial Sequence: Synthetic oligonucleotide
  Description of Combined DNA/RNA Molecule: Synthetic oligonucleotide
aaggagauaccgugcggugcutt

SEQ ID NO: 525 - DNA, 19 bp, Artificial Sequence
  Description of Artificial Sequence: Synthetic oligonucleotide
ccggacagttccatgtata

SEQ ID NO: 526 - DNA, 21 bp, Artificial Sequence
  Description of Artificial Sequence: Synthetic oligonucleotide
  Description of Combined DNA/RNA Molecule: Synthetic oligonucleotide
ggagaaaagccuuacagautt

SEQ ID NO: 527 - DNA, 21 bp, Artificial Sequence
  Description of Artificial Sequence: Synthetic oligonucleotide
  Description of Combined DNA/RNA Molecule: Synthetic oligonucleotide
guauuuggccgccgacgcatt

SEQ ID NO: 528 - DNA, 21 bp, Artificial Sequence
  Description of Artificial Sequence: Synthetic oligonucleotide
aagactggagaaagtggcatg

SEQ ID NO: 529 - DNA, 23 bp, Artificial Sequence
  Description of Artificial Sequence: Synthetic oligonucleotide
  Description of Combined DNA/RNA Molecule: Synthetic oligonucleotide
aaucacuguggagacauuugctt

SEQ ID NO: 530 - DNA, 23 bp, Artificial Sequence
  Description of Artificial Sequence: Synthetic oligonucleotide
  Description of Combined DNA/RNA Molecule: Synthetic oligonucleotide
aaugaagagggacacuucccutt

SEQ ID NO: 531 - DNA, 23 bp, Artificial Sequence
  Description of Artificial Sequence: Synthetic oligonucleotide
  Description of Combined DNA/RNA Molecule: Synthetic oligonucleotide
aaccucgcugcaaagaaugugtt

SEQ ID NO: 532 - DNA, 23 bp, Artificial Sequence
  Description of Artificial Sequence: Synthetic oligonucleotide
  Description of Combined DNA/RNA Molecule: Synthetic oligonucleotide
aacuccaucuguucuccugactt

SEQ ID NO: 533 - DNA, 23 bp, Artificial Sequence
  Description of Artificial Sequence: Synthetic oligonucleotide
  Description of Combined DNA/RNA Molecule: Synthetic oligonucleotide
aaaguuugcuuggcacaccuutt

SEQ ID NO: 534 - DNA, 20 bp, Artificial Sequence
  Description of Artificial Sequence: Synthetic oligonucleotide
aaggcctaatgccgaacaca

SEQ ID NO: 535 - DNA, 21 bp, Artificial Sequence
  Description of Artificial Sequence: Synthetic oligonucleotide
aactttggctgccatcatcca

SEQ ID NO: 536 - DNA, 21 bp, Artificial Sequence
  Description of Artificial Sequence: Synthetic oligonucleotide
  Description of Combined DNA/RNA Molecule: Synthetic oligonucleotide
uaagcuccaagagaaaggctt

SEQ ID NO: 537 - DNA, 19 bp, Artificial Sequence
  Description of Artificial Sequence: Synthetic oligonucleotide
  Description of Combined DNA/RNA Molecule: Synthetic oligonucleotide
gcccuaucccuuuacguca

SEQ ID NO: 538 - DNA, 39 bp, Artificial Sequence
  Description of Artificial Sequence: Synthetic oligonucleotide
gtggaccatgcactgcatgcctatagtgagtcgtattac

SEQ ID NO: 539 - DNA, 19 bp, Artificial Sequence
  Description of Artificial Sequence: Synthetic oligonucleotide
agatcctggctaactgttc

SEQ ID NO: 540 - DNA, 19 bp, Artificial Sequence
  Description of Artificial Sequence: Synthetic oligonucleotide
tacggactcaccttgcttg

SEQ ID NO: 541 - DNA, 21 bp, Artificial Sequence
  Description of Artificial Sequence: Synthetic oligonucleotide
  Description of Combined DNA/RNA Molecule: Synthetic oligonucleotide
cuggacacaguguguuugatt

SEQ ID NO: 542 - DNA, 21 bp, Artificial Sequence
  Description of Artificial Sequence: Synthetic oligonucleotide
  Description of Combined DNA/RNA Molecule: Synthetic oligonucleotide
cugaugaccagcaacuugatt

SEQ ID NO: 543 - DNA, 21 bp, Artificial Sequence
  Description of Artificial Sequence: Synthetic oligonucleotide
  Description of Combined DNA/RNA Molecule: Synthetic oligonucleotide
gcucuucgccauggacacatt

SEQ ID NO: 544 - DNA, 21 bp, Artificial Sequence
  Description of Artificial Sequence: Synthetic oligonucleotide
  Description of Combined DNA/RNA Molecule: Synthetic oligonucleotide
gcgacagcuggaguaugaatt

SEQ ID NO: 545 - DNA, 20 bp, Artificial Sequence
  Description of Artificial Sequence: Synthetic oligonucleotide
  Description of Combined DNA/RNA Molecule: Synthetic oligonucleotide
ccaugagcaccguucucctt

SEQ ID NO: 546 - DNA, 21 bp, Artificial Sequence
  Description of Artificial Sequence: Synthetic oligonucleotide
  Description of Combined DNA/RNA Molecule: Synthetic oligonucleotide
cuugaccaaggagcucaactt

SEQ ID NO: 547 - DNA, 21 bp, Artificial Sequence
  Description of Artificial Sequence: Synthetic oligonucleotide
  Description of Combined DNA/RNA Molecule: Synthetic oligonucleotide
ggagcucaacuucaccacctt

SEQ ID NO: 548 - DNA, 21 bp, Artificial Sequence
  Description of Artificial Sequence: Synthetic oligonucleotide
  Description of Combined DNA/RNA Molecule: Synthetic oligonucleotide
cggccacucgcuuccgggctt

SEQ ID NO: 549 - RNA, 19 nt, Artificial Sequence
  Description of Artificial Sequence: Synthetic oligonucleotide
gcuccgucgacugcgcgcc

SEQ ID NO: 550 - DNA, 21 bp, Artificial Sequence
  Description of Artificial Sequence: Synthetic oligonucleotide
aaaccaccgtggagctctact

SEQ ID NO: 551 - DNA, 21 bp, Artificial Sequence
  Description of Artificial Sequence: Synthetic oligonucleotide
aagagcccgaccttctgtgaa

SEQ ID NO: 552 - DNA, 21 bp, Artificial Sequence
  Description of Artificial Sequence: Synthetic oligonucleotide
  Description of Combined DNA/RNA Molecule: Synthetic oligonucleotide
guucuuccgccagauugugtt

SEQ ID NO: 553 - RNA, 21 nt, Artificial Sequence
  Description of Artificial Sequence: Synthetic oligonucleotide
cggacuacccuuagcacaauu

SEQ ID NO: 554 - RNA, 21 nt, Artificial Sequence
  Description of Artificial Sequence: Synthetic oligonucleotide
gaauagucaccauauucacuu

SEQ ID NO: 555 - DNA, 19 bp, Artificial Sequence
  Description of Artificial Sequence: Synthetic oligonucleotide
ggttccatcgaatcctgca

SEQ ID NO: 556 - DNA, 21 bp, Artificial Sequence
  Description of Artificial Sequence: Synthetic oligonucleotide
aacaagatcaccttctccgag

SEQ ID NO: 557 - DNA, 21 bp, Artificial Sequence
  Description of Artificial Sequence: Synthetic oligonucleotide
aactttgagaacatgagcaac

SEQ ID NO: 558 - DNA, 19 bp, Artificial Sequence
  Description of Artificial Sequence: Synthetic oligonucleotide
cgtggatttatggtctgtg

SEQ ID NO: 559 - DNA, 21 bp, Artificial Sequence
  Description of Artificial Sequence: Synthetic oligonucleotide
  Description of Combined DNA/RNA Molecule: Synthetic oligonucleotide
uggaugucuaucagcgcagtt

SEQ ID NO: 560 - DNA, 21 bp, Artificial Sequence
  Description of Artificial Sequence: Synthetic oligonucleotide
  Description of Combined DNA/RNA Molecule: Synthetic oligonucleotide
gcuacugccauccaaucgatt

SEQ ID NO: 561 - DNA, 21 bp, Artificial Sequence
  Description of Artificial Sequence: Synthetic oligonucleotide
  Description of Combined DNA/RNA Molecule: Synthetic oligonucleotide
ggaguacccugaugagauctt

SEQ ID NO: 562 - DNA, 21 bp, Artificial Sequence
  Description of Artificial Sequence: Synthetic oligonucleotide
  Description of Combined DNA/RNA Molecule: Synthetic oligonucleotide
cugaggaguccaacaucactt

SEQ ID NO: 563 - DNA, 21 bp, Artificial Sequence
  Description of Artificial Sequence: Synthetic oligonucleotide
  Description of Combined DNA/RNA Molecule: Synthetic oligonucleotide
ccaaggccagcacauaggatt

SEQ ID NO: 564 - DNA, 18 bp, Artificial Sequence
  Description of Artificial Sequence: Synthetic oligonucleotide
gtcgtgacttgcgacaag

SEQ ID NO: 565 - DNA, 21 bp, Artificial Sequence
  Description of Artificial Sequence: Synthetic oligonucleotide
  Description of Combined DNA/RNA Molecule: Synthetic oligonucleotide
gcuggcaguucauaggaautt

SEQ ID NO: 566 - DNA, 21 bp, Artificial Sequence
  Description of Artificial Sequence: Synthetic oligonucleotide
  Description of Combined DNA/RNA Molecule: Synthetic oligonucleotide
cgugcuccaaagucuguuatt

SEQ ID NO: 567 - DNA, 21 bp, Artificial Sequence
  Description of Artificial Sequence: Synthetic oligonucleotide
  Description of Combined DNA/RNA Molecule: Synthetic oligonucleotide
ucaguauguugugcaagagtt

SEQ ID NO: 568 - DNA, 21 bp, Artificial Sequence
  Description of Artificial Sequence: Synthetic oligonucleotide
  Description of Combined DNA/RNA Molecule: Synthetic oligonucleotide
gaagauacucuggaauucctt

SEQ ID NO: 569 - DNA, 21 bp, Artificial Sequence
  Description of Artificial Sequence: Synthetic oligonucleotide
  Description of Combined DNA/RNA Molecule: Synthetic oligonucleotide
cuggauuucacagagacugtt

SEQ ID NO: 570 - DNA, 21 bp, Artificial Sequence
  Description of Artificial Sequence: Synthetic oligonucleotide
  Description of Combined DNA/RNA Molecule: Synthetic oligonucleotide
gcagagaucauagagacugtt

SEQ ID NO: 571 - DNA, 21 bp, Artificial Sequence
  Description of Artificial Sequence: Synthetic oligonucleotide
  Description of Combined DNA/RNA Molecule: Synthetic oligonucleotide
gacuuuccucagaaugacgtt

SEQ ID NO: 572 - DNA, 21 bp, Artificial Sequence
  Description of Artificial Sequence: Synthetic oligonucleotide
  Description of Combined DNA/RNA Molecule: Synthetic oligonucleotide
cauuacuccaccuguaucatt

SEQ ID NO: 573 - DNA, 21 bp, Artificial Sequence
  Description of Artificial Sequence: Synthetic oligonucleotide
  Description of Combined DNA/RNA Molecule: Synthetic oligonucleotide
ggauuucaggaugaacacgtt

SEQ ID NO: 574 - DNA, 21 bp, Artificial Sequence
  Description of Artificial Sequence: Synthetic oligonucleotide
  Description of Combined DNA/RNA Molecule: Synthetic oligonucleotide
gcugcaggacuuccaccagtt

SEQ ID NO: 575 - RNA, 21 nt, Artificial Sequence
  Description of Artificial Sequence: Synthetic oligonucleotide
aauuggaacagcugcagcaga

SEQ ID NO: 576 - RNA, 21 nt, Artificial Sequence
  Description of Artificial Sequence: Synthetic oligonucleotide
aagcucugauuuaucaaaaga

SEQ ID NO: 577 - RNA, 19 nt, Artificial Sequence
  Description of Artificial Sequence: Synthetic oligonucleotide
cccacaccauuccauucua

SEQ ID NO: 578 - RNA, 23 nt, Artificial Sequence
  Description of Artificial Sequence: Synthetic oligonucleotide
aagaugaggaagaaaucgauguu

SEQ ID NO: 579 - RNA, 23 nt, Artificial Sequence
  Description of Artificial Sequence: Synthetic oligonucleotide
aaaaggucagagucuggaucacc

SEQ ID NO: 580 - RNA, 23 nt, Artificial Sequence
  Description of Artificial Sequence: Synthetic oligonucleotide
cacgucuccacacaucagcacaa

SEQ ID NO: 581 - RNA, 23 nt, Artificial Sequence
  Description of Artificial Sequence: Synthetic oligonucleotide
aaaugagauaaagguggcuaauu

SEQ ID NO: 582 - RNA, 19 nt, Artificial Sequence
  Description of Artificial Sequence: Synthetic oligonucleotide
ugguugcauuguccauggc

SEQ ID NO: 583 - DNA, 19 bp, Artificial Sequence
  Description of Artificial Sequence: Synthetic oligonucleotide
gatcgctgtgtgtctgtaa

SEQ ID NO: 584 - DNA, 19 bp, Artificial Sequence
  Description of Artificial Sequence: Synthetic oligonucleotide
gtccgtatgtaaatcagat

SEQ ID NO: 585 - DNA, 19 bp, Artificial Sequence
  Description of Artificial Sequence: Synthetic oligonucleotide
cataccatctctaccgacg

SEQ ID NO: 586 - DNA, 19 bp, Artificial Sequence
  Description of Artificial Sequence: Synthetic oligonucleotide
actgaagtctcggccagct

SEQ ID NO: 587 - DNA, 19 bp, Artificial Sequence
  Description of Artificial Sequence: Synthetic oligonucleotide
gaaactcgtcgcatcttcc

SEQ ID NO: 588 - DNA, 21 bp, Artificial Sequence
  Description of Artificial Sequence: Synthetic oligonucleotide
  Description of Combined DNA/RNA Molecule: Synthetic oligonucleotide
aucugcagaggccuccgcatt

SEQ ID NO: 589 - DNA, 21 bp, Artificial Sequence
  Description of Artificial Sequence: Synthetic oligonucleotide
gagcagaaccttcagaatatt

SEQ ID NO: 590 - DNA, 21 bp, Artificial Sequence
  Description of Artificial Sequence: Synthetic oligonucleotide
gagcagggcttcaccattgtt

SEQ ID NO: 591 - DNA, 21 bp, Artificial Sequence
  Description of Artificial Sequence: Synthetic oligonucleotide
ggaaggagaagaattcgtatt

SEQ ID NO: 592 - DNA, 21 bp, Artificial Sequence
  Description of Artificial Sequence: Synthetic oligonucleotide
gatatcatctttctctgaatt

SEQ ID NO: 593 - DNA, 19 bp, Artificial Sequence
  Description of Artificial Sequence: Synthetic oligonucleotide
caactacggctttgccaat

SEQ ID NO: 594 - DNA, 19 bp, Artificial Sequence
  Description of Artificial Sequence: Synthetic oligonucleotide
gcaactcacgctccggaaa

SEQ ID NO: 595 - DNA, 19 bp, Artificial Sequence
  Description of Artificial Sequence: Synthetic oligonucleotide
gccctgagctggactactt

SEQ ID NO: 596 - DNA, 19 bp, Artificial Sequence
  Description of Artificial Sequence: Synthetic oligonucleotide
ggtatgcgacgggaaagta

SEQ ID NO: 597 - DNA, 21 bp, Artificial Sequence
  Description of Artificial Sequence: Synthetic oligonucleotide
aactcggaatccgaagttgga

SEQ ID NO: 598 - DNA, 21 bp, Artificial Sequence
  Description of Artificial Sequence: Synthetic oligonucleotide
aaagacctgagggaccgggag

SEQ ID NO: 599 - DNA, 19 bp, Artificial Sequence
  Description of Artificial Sequence: Synthetic oligonucleotide
gagaaaatgagctgtccgc

SEQ ID NO: 600 - DNA, 19 bp, Artificial Sequence
  Description of Artificial Sequence: Synthetic oligonucleotide
ctggcagaagtagcagaac

SEQ ID NO: 601 - RNA, 21 nt, Artificial Sequence
  Description of Artificial Sequence: Synthetic oligonucleotide
aaggcuuuggaacagaaacca

SEQ ID NO: 602 - RNA, 21 nt, Artificial Sequence
  Description of Artificial Sequence: Synthetic oligonucleotide
aagagucgggaccacaguuua

SEQ ID NO: 603 - DNA, 21 bp, Artificial Sequence
  Description of Artificial Sequence: Synthetic oligonucleotide
  Description of Combined DNA/RNA Molecule: Synthetic oligonucleotide
acagacuucggaguaccugtt

SEQ ID NO: 604 - DNA, 21 bp, Artificial Sequence
  Description of Artificial Sequence: Synthetic oligonucleotide
  Description of Combined DNA/RNA Molecule: Synthetic oligonucleotide
cggugcucaugcuuacaactt

SEQ ID NO: 605 - DNA, 21 bp, Artificial Sequence
  Description of Artificial Sequence: Synthetic oligonucleotide
  Description of Combined DNA/RNA Molecule: Synthetic oligonucleotide
cgaguugcuagaccgcuuctt

SEQ ID NO: 606 - RNA, 21 nt, Artificial Sequence
  Description of Artificial Sequence: Synthetic oligonucleotide
aaugccggugacacaacauga

SEQ ID NO: 607 - DNA, 20 bp, Artificial Sequence
  Description of Artificial Sequence: Synthetic oligonucleotide
tacgggagcagatgatgaaa

SEQ ID NO: 608 - DNA, 21 bp, Artificial Sequence
  Description of Artificial Sequence: Synthetic oligonucleotide
aacccaaatccatggaaaata

SEQ ID NO: 609 - DNA, 53 bp, Artificial Sequence
  Description of Artificial Sequence: Synthetic oligonucleotide
gagcagtggaaggacagcattcaagagatgctgtccttccactgctctttttt

SEQ ID NO: 610 - DNA, 64 bp, Artificial Sequence
  Description of Artificial Sequence: Synthetic oligonucleotide
gatcccgagcagtggaaggacagcattcaagagatgctgtccttccactgctcttttttggaaa

SEQ ID NO: 611 - DNA, 19 bp, Artificial Sequence
  Description of Artificial Sequence: Synthetic oligonucleotide
ggaccaggcagagaatgag

SEQ ID NO: 612 - RNA, 21 nt, Artificial Sequence
  Description of Artificial Sequence: Synthetic oligonucleotide
aagacacaggccaacgacuac

SEQ ID NO: 613 - RNA, 21 nt, Artificial Sequence
  Description of Artificial Sequence: Synthetic oligonucleotide
aagauugugaagcagaaggcc

SEQ ID NO: 614 - DNA, 21 bp, Artificial Sequence
  Description of Artificial Sequence: Synthetic oligonucleotide
aatctccttgcgccacagaat

SEQ ID NO: 615 - DNA, 21 bp, Artificial Sequence
  Description of Artificial Sequence: Synthetic oligonucleotide
aagtcagctggatgaaccaag

SEQ ID NO: 616 - RNA, 21 nt, Artificial Sequence
  Description of Artificial Sequence: Synthetic oligonucleotide
aagauccgacagagcgccuca

SEQ ID NO: 617 - DNA, 21 bp, Artificial Sequence
  Description of Artificial Sequence: Synthetic oligonucleotide
aatgcaactgcagaagcagaa

SEQ ID NO: 618 - DNA, 21 bp, Artificial Sequence
  Description of Artificial Sequence: Synthetic oligonucleotide
aagcaagtcgaggtagattgc

SEQ ID NO: 619 - RNA, 19 nt, Artificial Sequence
  Description of Artificial Sequence: Synthetic oligonucleotide
cagcuaacugcacuccgag

SEQ ID NO: 620 - RNA, 19 nt, Artificial Sequence
  Description of Artificial Sequence: Synthetic oligonucleotide
ugauauuauggaagcaaau

SEQ ID NO: 621 - DNA, 21 bp, Artificial Sequence
  Description of Artificial Sequence: Synthetic oligonucleotide
aaggcttttcccagtccttca

SEQ ID NO: 622 - DNA, 21 bp, Artificial Sequence
  Description of Artificial Sequence: Synthetic oligonucleotide
aagatgatggtgtgccaagtg

SEQ ID NO: 623 - DNA, 21 bp, Artificial Sequence
  Description of Artificial Sequence: Synthetic oligonucleotide
aatgttataggcatccgagac

SEQ ID NO: 624 - DNA, 21 bp, Artificial Sequence
  Description of Artificial Sequence: Synthetic oligonucleotide
aacccaaacaagcgcatcaca

SEQ ID NO: 625 - DNA, 21 bp, Artificial Sequence
  Description of Artificial Sequence: Synthetic oligonucleotide
aaagttcgagttgctatcaag

SEQ ID NO: 626 - DNA, 19 bp, Artificial Sequence
  Description of Artificial Sequence: Synthetic oligonucleotide
gcgcatgaggaaccgcatt

SEQ ID NO: 627 - DNA, 19 bp, Artificial Sequence
  Description of Artificial Sequence: Synthetic oligonucleotide
gaccaggagcgcatcaaag

SEQ ID NO: 628 - DNA, 19 bp, Artificial Sequence
  Description of Artificial Sequence: Synthetic oligonucleotide
aagccagaacaccgagctg

SEQ ID NO: 629 - DNA, 19 bp, Artificial Sequence
  Description of Artificial Sequence: Synthetic oligonucleotide
gcggagacagatcaacttg

SEQ ID NO: 630 - DNA, 19 bp, Artificial Sequence
  Description of Artificial Sequence: Synthetic oligonucleotide
attggaggatgagaaatcg

SEQ ID NO: 631 - DNA, 19 bp, Artificial Sequence
  Description of Artificial Sequence: Synthetic oligonucleotide
tcaacgccatcaccaccag

SEQ ID NO: 632 - RNA, 21 nt, Artificial Sequence
  Description of Artificial Sequence: Synthetic oligonucleotide
aacgaugaagcccuggagugc

SEQ ID NO: 633 - DNA, 23 bp, Artificial Sequence
  Description of Artificial Sequence: Synthetic oligonucleotide
acttcatcagaatggcagggttt

SEQ ID NO: 634 - DNA, 21 bp, Artificial Sequence
  Description of Artificial Sequence: Synthetic oligonucleotide
aaccggaggtcaggtcgaaat

SEQ ID NO: 635 - DNA, 21 bp, Artificial Sequence
  Description of Artificial Sequence: Synthetic oligonucleotide
aagcagagtgacctggtagat

SEQ ID NO: 636 - DNA, 21 bp, Artificial Sequence
  Description of Artificial Sequence: Synthetic oligonucleotide
  Description of Combined DNA/RNA Molecule: Synthetic oligonucleotide
caccaccauugaggacgaatt

SEQ ID NO: 637 - DNA, 21 bp, Artificial Sequence
  Description of Artificial Sequence: Synthetic oligonucleotide
  Description of Combined DNA/RNA Molecule: Synthetic oligonucleotide
gugaccaccuuacuacucatt

SEQ ID NO: 638 - DNA, 21 bp, Artificial Sequence
  Description of Artificial Sequence: Synthetic oligonucleotide
  Description of Combined DNA/RNA Molecule: Synthetic oligonucleotide
guuugccaggagugacgaatt

SEQ ID NO: 639 - DNA, 21 bp, Artificial Sequence
  Description of Artificial Sequence: Synthetic oligonucleotide
  Description of Combined DNA/RNA Molecule: Synthetic oligonucleotide
ggcuuuucauguaucagcutt

SEQ ID NO: 640 - DNA, 21 bp, Artificial Sequence
  Description of Artificial Sequence: Synthetic oligonucleotide
  Description of Combined DNA/RNA Molecule: Synthetic oligonucleotide
ggcaauggcuugguuuuuutt

SEQ ID NO: 641 - DNA, 21 bp, Artificial Sequence
  Description of Artificial Sequence: Synthetic oligonucleotide
  Description of Combined DNA/RNA Molecule: Synthetic oligonucleotide
ggaguacauggagacagactt

SEQ ID NO: 642 - DNA, 19 bp, Artificial Sequence
  Description of Artificial Sequence: Synthetic oligonucleotide
gtcgagacatcttgactga

SEQ ID NO: 643 - DNA, 19 bp, Artificial Sequence
  Description of Artificial Sequence: Synthetic oligonucleotide
gacacggatctgagaatct

SEQ ID NO: 644 - RNA, 19 nt, Artificial Sequence
  Description of Artificial Sequence: Synthetic oligonucleotide
ggacgugguugaggaauuc

SEQ ID NO: 645 - DNA, 21 bp, Artificial Sequence
  Description of Artificial Sequence: Synthetic oligonucleotide
tagcagcacatcagtcgaata

SEQ ID NO: 646 - DNA, 21 bp, Artificial Sequence
  Description of Artificial Sequence: Synthetic oligonucleotide
cccaatattgtcaattattta

SEQ ID NO: 647 - DNA, 19 bp, Artificial Sequence
  Description of Artificial Sequence: Synthetic oligonucleotide
cacaaagctggtgtgtgca

SEQ ID NO: 648 - DNA, 21 bp, Artificial Sequence
  Description of Artificial Sequence: Synthetic oligonucleotide
aaccggaggtcaggtcgaaat

SEQ ID NO: 649 - DNA, 21 bp, Artificial Sequence
  Description of Artificial Sequence: Synthetic oligonucleotide
aagcagagtgacctggtagat

SEQ ID NO: 650 - DNA, 21 bp, Artificial Sequence
  Description of Artificial Sequence: Synthetic oligonucleotide
aagccgtcctgtgtgccgctg

SEQ ID NO: 651 - DNA, 21 bp, Artificial Sequence
  Description of Artificial Sequence: Synthetic oligonucleotide
aacgatgaagccctggagtgc

SEQ ID NO: 652 - DNA, 21 bp, Artificial Sequence
  Description of Artificial Sequence: Synthetic oligonucleotide
aagttaaaagtgcctgaactg

SEQ ID NO: 653 - DNA, 21 bp, Artificial Sequence
  Description of Artificial Sequence: Synthetic oligonucleotide
aagcaggccagactctctttc

SEQ ID NO: 654 - DNA, 21 bp, Artificial Sequence
  Description of Artificial Sequence: Synthetic oligonucleotide
aagctcagcacacagaaagac

SEQ ID NO: 655 - DNA, 21 bp, Artificial Sequence
  Description of Artificial Sequence: Synthetic oligonucleotide
aatgcggcggtggtgacagta

SEQ ID NO: 656 - DNA, 47 bp, Artificial Sequence
  Description of Artificial Sequence: Synthetic oligonucleotide
gggacatagccaagctggtcgagtactggaccagcttggctatgtcc

SEQ ID NO: 657 - DNA, 21 bp, Artificial Sequence
  Description of Artificial Sequence: Synthetic oligonucleotide
aactacggttgctggagacag

SEQ ID NO: 658 - DNA, 19 bp, Artificial Sequence
  Description of Artificial Sequence: Synthetic oligonucleotide
caacaaccacaaccataac

SEQ ID NO: 659 - DNA, 21 bp, Artificial Sequence
  Description of Artificial Sequence: Synthetic oligonucleotide
cataaccacaaccaccacttt

SEQ ID NO: 660 - DNA, 19 bp, Artificial Sequence
  Description of Artificial Sequence: Synthetic oligonucleotide
tgtgagctcacatcttgat

SEQ ID NO: 661 - DNA, 19 bp, Artificial Sequence
  Description of Artificial Sequence: Synthetic oligonucleotide
ccaggagtttgacacaatg

SEQ ID NO: 662 - DNA, 19 bp, Artificial Sequence
  Description of Artificial Sequence: Synthetic oligonucleotide
gatcaatggctacacagga

SEQ ID NO: 663 - DNA, 19 bp, Artificial Sequence
  Description of Artificial Sequence: Synthetic oligonucleotide
gagccaagaacaaaattgc

SEQ ID NO: 664 - DNA, 19 bp, Artificial Sequence
  Description of Artificial Sequence: Synthetic oligonucleotide
gaaagtgcgccgtgccatc

SEQ ID NO: 665 - DNA, 21 bp, Artificial Sequence
  Description of Artificial Sequence: Synthetic oligonucleotide
  Description of Combined DNA/RNA Molecule: Synthetic oligonucleotide
ccacuguggcauugaaucatt

SEQ ID NO: 666 - DNA, 21 bp, Artificial Sequence
  Description of Artificial Sequence: Synthetic oligonucleotide
aacgccacctcgtttgttttc

SEQ ID NO: 667 - DNA, 20 bp, Artificial Sequence
  Description of Artificial Sequence: Synthetic oligonucleotide
  Description of Combined DNA/RNA Molecule: Synthetic oligonucleotide
gauguggacagugucugutt

SEQ ID NO: 668 - DNA, 21 bp, Artificial Sequence
  Description of Artificial Sequence: Synthetic oligonucleotide
  Description of Combined DNA/RNA Molecule: Synthetic oligonucleotide
augcagcuggagauggcactt

SEQ ID NO: 669 - DNA, 19 bp, Artificial Sequence
  Description of Artificial Sequence: Synthetic oligonucleotide
cgtggatgaggttgagaca

SEQ ID NO: 670 - DNA, 19 bp, Artificial Sequence
  Description of Artificial Sequence: Synthetic oligonucleotide
ggtggacaacaacttcaca

SEQ ID NO: 671 - DNA, 19 bp, Artificial Sequence
  Description of Artificial Sequence: Synthetic oligonucleotide
gaaggtggagaaccatatc

SEQ ID NO: 672 - DNA, 19 bp, Artificial Sequence
  Description of Artificial Sequence: Synthetic oligonucleotide
gcacttgaactactggtat

SEQ ID NO: 673 - DNA, 21 bp, Artificial Sequence
  Description of Artificial Sequence: Synthetic oligonucleotide
aagctgagcaagattcagacc

SEQ ID NO: 674 - DNA, 21 bp, Artificial Sequence
  Description of Artificial Sequence: Synthetic oligonucleotide
aggtacatcgacttcctgtac

SEQ ID NO: 675 - DNA, 21 bp, Artificial Sequence
  Description of Artificial Sequence: Synthetic oligonucleotide
agcgggtcatggctaacgtgc

SEQ ID NO: 676 - RNA, 22 nt, Artificial Sequence
  Description of Artificial Sequence: Synthetic oligonucleotide
gggagcagaagcaggugcagau

SEQ ID NO: 677 - DNA, 21 bp, Artificial Sequence
  Description of Artificial Sequence: Synthetic oligonucleotide
gcccattgaaaccaagaaatt

SEQ ID NO: 678 - DNA, 52 bp, Artificial Sequence
  Description of Artificial Sequence: Synthetic oligonucleotide
agacgcagaggccttggttcaagagaccaaggcctctgcgtctgactttttc

SEQ ID NO: 679 - DNA, 22 bp, Artificial Sequence
  Description of Artificial Sequence: Synthetic oligonucleotide
  Description of Combined DNA/RNA Molecule: Synthetic oligonucleotide
gaagcacagagugaagaccatt

SEQ ID NO: 680 - DNA, 21 bp, Artificial Sequence
  Description of Artificial Sequence: Synthetic oligonucleotide
cgagcaggagaacagcgagtt

SEQ ID NO: 681 - DNA, 19 bp, Artificial Sequence
  Description of Artificial Sequence: Synthetic oligonucleotide
gatggttatccaggtggca

SEQ ID NO: 682 - DNA, 21 bp, Artificial Sequence
  Description of Artificial Sequence: Synthetic oligonucleotide
  Description of Combined DNA/RNA Molecule: Synthetic oligonucleotide
cuguugugguuaaacuccutt

SEQ ID NO: 683 - DNA, 21 bp, Artificial Sequence
  Description of Artificial Sequence: Synthetic oligonucleotide
gccttgacaacgttaggaatc

SEQ ID NO: 684 - DNA, 21 bp, Artificial Sequence
  Description of Artificial Sequence: Synthetic oligonucleotide
gcaggaagttcccaccttgac

SEQ ID NO: 685 - DNA, 18 bp, Artificial Sequence
  Description of Artificial Sequence: Synthetic oligonucleotide
gcctgatgaagaagttcc

SEQ ID NO: 686 - DNA, 19 bp, Artificial Sequence
  Description of Artificial Sequence: Synthetic oligonucleotide
gctagaaaaagctgagatc

SEQ ID NO: 687 - DNA, 21 bp, Artificial Sequence
  Description of Artificial Sequence: Synthetic oligonucleotide
  Description of Combined DNA/RNA Molecule: Synthetic oligonucleotide
cauccuaaggcccgauuuctt

SEQ ID NO: 688 - DNA, 21 bp, Artificial Sequence
  Description of Artificial Sequence: Synthetic oligonucleotide
  Description of Combined DNA/RNA Molecule: Synthetic oligonucleotide
guucccggaacacaacccutt

SEQ ID NO: 689 - DNA, 21 bp, Artificial Sequence
  Description of Artificial Sequence: Synthetic oligonucleotide
  Description of Combined DNA/RNA Molecule: Synthetic oligonucleotide
gcagcuucaggaugagaugtt

SEQ ID NO: 690 - DNA, 21 bp, Artificial Sequence
  Description of Artificial Sequence: Synthetic oligonucleotide
  Description of Combined DNA/RNA Molecule: Synthetic oligonucleotide
caguuuugaguauucggggtt

SEQ ID NO: 691 - DNA, 20 bp, Artificial Sequence
  Description of Artificial Sequence: Synthetic oligonucleotide
  Description of Combined DNA/RNA Molecule: Synthetic oligonucleotide
gaucaccugcacuucgagtt

SEQ ID NO: 692 - DNA, 21 bp, Artificial Sequence
  Description of Artificial Sequence: Synthetic oligonucleotide
  Description of Combined DNA/RNA Molecule: Synthetic oligonucleotide
cugaacagugcccuuuucctt

SEQ ID NO: 693 - DNA, 19 bp, Artificial Sequence
  Description of Artificial Sequence: Synthetic oligonucleotide
ttatgagaagtctgacaag

SEQ ID NO: 694 - DNA, 19 bp, Artificial Sequence
  Description of Artificial Sequence: Synthetic oligonucleotide
gattcttggctaaatccca

SEQ ID NO: 695 - DNA, 19 bp, Artificial Sequence
  Description of Artificial Sequence: Synthetic oligonucleotide
ggacatttgaacaacagca

SEQ ID NO: 696 - DNA, 24 bp, Artificial Sequence
  Description of Artificial Sequence: Synthetic oligonucleotide
aatttatggagtcaaccacagctt

SEQ ID NO: 697 - DNA, 21 bp, Artificial Sequence
  Description of Artificial Sequence: Synthetic oligonucleotide
  Description of Combined DNA/RNA Molecule: Synthetic oligonucleotide
gccgguuuuccauacucuctt

SEQ ID NO: 698 - DNA, 21 bp, Artificial Sequence
  Description of Artificial Sequence: Synthetic oligonucleotide
  Description of Combined DNA/RNA Molecule: Synthetic oligonucleotide
caagaagaugcgccgcaactt

SEQ ID NO: 699 - DNA, 21 bp, Artificial Sequence
  Description of Artificial Sequence: Synthetic oligonucleotide
  Description of Combined DNA/RNA Molecule: Synthetic oligonucleotide
ugguggucacagauaccagtt

SEQ ID NO: 700 - RNA, 21 nt, Artificial Sequence
  Description of Artificial Sequence: Synthetic oligonucleotide
gucugguaagacuggaguacc

SEQ ID NO: 701 - RNA, 21 nt, Artificial Sequence
  Description of Artificial Sequence: Synthetic oligonucleotide
uuggagaugaacuggacaauu

SEQ ID NO: 702 - RNA, 21 nt, Artificial Sequence
  Description of Artificial Sequence: Synthetic oligonucleotide
cuggacaauaauauggagcuu

SEQ ID NO: 703 - RNA, 21 nt, Artificial Sequence
  Description of Artificial Sequence: Synthetic oligonucleotide
agaacuuugugcuuuaauguu

SEQ ID NO: 704 - RNA, 21 nt, Artificial Sequence
  Description of Artificial Sequence: Synthetic oligonucleotide
uauaggcauauacuggauguu

SEQ ID NO: 705 - RNA, 21 nt, Artificial Sequence
  Description of Artificial Sequence: Synthetic oligonucleotide
agugaaaaccuugaaagcguu

SEQ ID NO: 706 - RNA, 21 nt, Artificial Sequence
  Description of Artificial Sequence: Synthetic oligonucleotide
agucaugaaccacguuaacuu

SEQ ID NO: 707 - DNA, 21 bp, Artificial Sequence
  Description of Artificial Sequence: Synthetic oligonucleotide
aatgagaacagcaacaactcc

SEQ ID NO: 708 - DNA, 21 bp, Artificial Sequence
  Description of Artificial Sequence: Synthetic oligonucleotide
aagttctcagacaatgactgc

SEQ ID NO: 709 - DNA, 60 bp, Artificial Sequence
  Description of Artificial Sequence: Synthetic oligonucleotide
tcgagacagtagtggttctacgtgccgagtactgggcacgtagaaccactactgtttttt

SEQ ID NO: 710 - RNA, 21 nt, Artificial Sequence
  Description of Artificial Sequence: Synthetic oligonucleotide
agaugacaggugcccagaguu

SEQ ID NO: 711 - DNA, 21 bp, Artificial Sequence
  Description of Artificial Sequence: Synthetic oligonucleotide
  Description of Combined DNA/RNA Molecule: Synthetic oligonucleotide
gguagaucaaagcaggaggtt

SEQ ID NO: 712 - DNA, 23 bp, Artificial Sequence
  Description of Artificial Sequence: Synthetic oligonucleotide
  Description of Combined DNA/RNA Molecule: Synthetic oligonucleotide
aacggagucccugcugcauuutt

SEQ ID NO: 713 - DNA, 23 bp, Artificial Sequence
  Description of Artificial Sequence: Synthetic oligonucleotide
  Description of Combined DNA/RNA Molecule: Synthetic oligonucleotide
aaccaugucaccaguccaguutt

SEQ ID NO: 714 - DNA, 23 bp, Artificial Sequence
  Description of Artificial Sequence: Synthetic oligonucleotide
  Description of Combined DNA/RNA Molecule: Synthetic oligonucleotide
aagccuguguuuggcuuuggatt

SEQ ID NO: 715 - DNA, 23 bp, Artificial Sequence
  Description of Artificial Sequence: Synthetic oligonucleotide
aaccattatggaagaagtacatt

SEQ ID NO: 716 - DNA, 21 bp, Artificial Sequence
  Description of Artificial Sequence: Synthetic oligonucleotide
  Description of Combined DNA/RNA Molecule: Synthetic oligonucleotide
ggguuauucugaacauguutt

SEQ ID NO: 717 - DNA, 21 bp, Artificial Sequence
  Description of Artificial Sequence: Synthetic oligonucleotide
gcaactggatttctgtgaagg

SEQ ID NO: 718 - DNA, 21 bp, Artificial Sequence
  Description of Artificial Sequence: Synthetic oligonucleotide
gaagcggatttcttccttctg

SEQ ID NO: 719 - DNA, 21 bp, Artificial Sequence
  Description of Artificial Sequence: Synthetic oligonucleotide
aaggagatcgacctggtcaac

SEQ ID NO: 720 - DNA, 21 bp, Artificial Sequence
  Description of Artificial Sequence: Synthetic oligonucleotide
aagggacacacagttttgacg

SEQ ID NO: 721 - DNA, 54 bp, Artificial Sequence
  Description of Artificial Sequence: Synthetic oligonucleotide
gaactacacaaattcagccaggcgtatcatccggtgtttcgtcctttccacaag

SEQ ID NO: 722 - DNA, 29 bp, Artificial Sequence
  Description of Artificial Sequence: Synthetic oligonucleotide
aaaaggcaaattcacaaacagcctgtctc

SEQ ID NO: 723 - DNA, 29 bp, Artificial Sequence
  Description of Artificial Sequence: Synthetic oligonucleotide
aagttctccgaagtgtgagaacctgtctc

SEQ ID NO: 724 - DNA, 21 bp, Artificial Sequence
  Description of Artificial Sequence: Synthetic oligonucleotide
aagctgacactgatctctgaa

SEQ ID NO: 725 - DNA, 19 bp, Artificial Sequence
  Description of Artificial Sequence: Synthetic oligonucleotide
ccaggagtttgacacaatg

SEQ ID NO: 726 - DNA, 21 bp, Artificial Sequence
  Description of Artificial Sequence: Synthetic oligonucleotide
  Description of Combined DNA/RNA Molecule: Synthetic oligonucleotide
ggacagauguuccuuaagatt

SEQ ID NO: 727 - DNA, 21 bp, Artificial Sequence
  Description of Artificial Sequence: Synthetic oligonucleotide
ggccaagggagggggagcgta

SEQ ID NO: 728 - DNA, 21 bp, Artificial Sequence
  Description of Artificial Sequence: Synthetic oligonucleotide
ggcgctggagtcaagtgtctc

SEQ ID NO: 729 - DNA, 21 bp, Artificial Sequence
  Description of Artificial Sequence: Synthetic oligonucleotide
  Description of Combined DNA/RNA Molecule: Synthetic oligonucleotide
augcagcuggagauggcactt

SEQ ID NO: 730 - DNA, 23 bp, Artificial Sequence
  Description of Artificial Sequence: Synthetic oligonucleotide
  Description of Combined DNA/RNA Molecule: Synthetic oligonucleotide
aauacaccgacaagcaaugactt

SEQ ID NO: 731 - DNA, 23 bp, Artificial Sequence
  Description of Artificial Sequence: Synthetic oligonucleotide
  Description of Combined DNA/RNA Molecule: Synthetic oligonucleotide
aaagucgguuaacagcgaucutt

SEQ ID NO: 732 - DNA, 19 bp, Artificial Sequence
  Description of Artificial Sequence: Synthetic oligonucleotide
cctttcatttctcctcctt

SEQ ID NO: 733 - DNA, 19 bp, Artificial Sequence
  Description of Artificial Sequence: Synthetic oligonucleotide
agctgctcctgtggctctg

SEQ ID NO: 734 - DNA, 19 bp, Artificial Sequence
  Description of Artificial Sequence: Synthetic oligonucleotide
gcctcctgcccagaaggca

SEQ ID NO: 735 - RNA, 18 nt, Artificial Sequence
  Description of Artificial Sequence: Synthetic oligonucleotide
ugagagaaagcacagaaa

SEQ ID NO: 736 - RNA, 19 nt, Artificial Sequence
  Description of Artificial Sequence: Synthetic oligonucleotide
uggacauccccaaaauuga

SEQ ID NO: 737 - RNA, 19 nt, Artificial Sequence
  Description of Artificial Sequence: Synthetic oligonucleotide
ccccaucaucuacaccaca

SEQ ID NO: 738 - protein, 4 aa, Homo sapiens
DEAD

SEQ ID NO: 739 - protein, 4 aa, Homo sapiens
YRPW

SEQ ID NO: 740 - DNA, 20 bp, Artificial Sequence
  Description of Artificial Sequence: Synthetic oligonucleotide
atggaaggtccaacgttctc

SEQ ID NO: 741 - DNA, 20 bp, Artificial Sequence
  Description of Artificial Sequence: Synthetic oligonucleotide
tccatgtcggtcctgctgat

SEQ ID NO: 742 - DNA, 20 bp, Artificial Sequence
  Description of Artificial Sequence: Synthetic oligonucleotide
atggaaggtccagtgttctc

SEQ ID NO: 743 - DNA, 26 bp, Artificial Sequence
  Description of Artificial Sequence: Synthetic oligonucleotide
ggggggtcaacgttgagggggggggg

SEQ ID NO: 744 - DNA, 26 bp, Artificial Sequence
  Description of Artificial Sequence: Synthetic oligonucleotide
ggggggtcaagtctgagggggggggg

SEQ ID NO: 745 - DNA, 15 bp, Artificial Sequence
  Description of Artificial Sequence: Synthetic oligonucleotide
gctagaccttagtgt

SEQ ID NO: 746 - DNA, 19 bp, Artificial Sequence
  Description of Artificial Sequence: Synthetic oligonucleotide
ggggtcaacgttgacgggg

SEQ ID NO: 747 - DNA, 19 bp, Artificial Sequence
  Description of Artificial Sequence: Synthetic oligonucleotide
ggggtcaagtctgacgggg

SEQ ID NO: 748 - DNA, 20 bp, Artificial Sequence
  Description of Artificial Sequence: Synthetic oligonucleotide
tccatgtccttcctgatgct

SEQ ID NO: 749 - DNA, 20 bp, Artificial Sequence
  Description of Artificial Sequence: Synthetic oligonucleotide
gagaacgctgcaccttccat

SEQ ID NO: 750 - DNA, 19 bp, Artificial Sequence
  Description of Artificial Sequence: Synthetic oligonucleotide
ggggtcagtcttgacgggg

SEQ ID NO: 751 - DNA, 20 bp, Artificial Sequence
  Description of Artificial Sequence: Synthetic oligonucleotide
tccaggacttctctcaagtt

SEQ ID NO: 752 - DNA, 23 bp, Artificial Sequence
  Description of Artificial Sequence: Synthetic oligonucleotide
tcgtcgttttgtcgttttgtcgt

SEQ ID NO: 753 - DNA, 54 bp, Artificial Sequence
  Description of Artificial Sequence: Synthetic oligonucleotide
gacttcgtgtcgttcttctgtcgtctttagcgcttctcctgcgtgcgtcccttg

SEQ ID NO: 754 - DNA, 20 bp, Artificial Sequence
  Description of Artificial Sequence: Synthetic oligonucleotide
ggggtcaacgttgagggggg

SEQ ID NO: 755 - DNA, 20 bp, Artificial Sequence
  Description of Artificial Sequence: Synthetic oligonucleotide
tccaggactttcctcaggtt

SEQ ID NO: 756 - DNA, 20 bp, Artificial Sequence
  Description of Artificial Sequence: Synthetic oligonucleotide
cccccccccccccccccccc

SEQ ID NO: 757 - DNA, 20 bp, Artificial Sequence
  Description of Artificial Sequence: Synthetic oligonucleotide
ggcggcggcggcggcggcgg

SEQ ID NO: 758 - DNA, 19 bp, Artificial Sequence
  Description of Artificial Sequence: Synthetic oligonucleotide
gggtcaacgttgagggggg

SEQ ID NO: 759 - DNA, 20 bp, Artificial Sequence
  Description of Artificial Sequence: Synthetic oligonucleotide
tctcccagcgtgcgccatat

SEQ ID NO: 760 - DNA, 21 bp, Artificial Sequence
  Description of Artificial Sequence: Synthetic oligonucleotide
ggggtctgtgcttttgggggg

SEQ ID NO: 761 - DNA, 20 bp, Artificial Sequence
  Description of Artificial Sequence: Synthetic oligonucleotide
tcaggggtggggggaacctt

SEQ ID NO: 762 - DNA, 20 bp, Artificial Sequence
  Description of Artificial Sequence: Synthetic oligonucleotide
ggggttgacgttttgggggg

SEQ ID NO: 763 - DNA, 20 bp, Artificial Sequence
  Description of Artificial Sequence: Synthetic oligonucleotide
tctagcgtttttagcgttcc

SEQ ID NO: 764 - DNA, 15 bp, Artificial Sequence
  Description of Artificial Sequence: Synthetic oligonucleotide
gcgtttttttttgcg

SEQ ID NO: 765 - DNA, 20 bp, Artificial Sequence
  Description of Artificial Sequence: Synthetic oligonucleotide
tccatgagcttcctgatgct

SEQ ID NO: 766 - DNA, 20 bp, Artificial Sequence
  Description of Artificial Sequence: Synthetic oligonucleotide
tccatgtcgttcctgatgcg

SEQ ID NO: 767 - DNA, 20 bp, Artificial Sequence
  Description of Artificial Sequence: Synthetic oligonucleotide
tccatgtcgttccgcgcgcg

SEQ ID NO: 768 - DNA, 20 bp, Artificial Sequence
  Description of Artificial Sequence: Synthetic oligonucleotide
tccatgtcgttcctgccgct

SEQ ID NO: 769 - DNA, 20 bp, Artificial Sequence
  Description of Artificial Sequence: Synthetic oligonucleotide
gcgcgcgcgcgcgcgcgcgc

SEQ ID NO: 770 - DNA, 20 bp, Artificial Sequence
  Description of Artificial Sequence: Synthetic oligonucleotide
ccggccggccggccggccgg

SEQ ID NO: 771 - DNA, 20 bp, Artificial Sequence
  Description of Artificial Sequence: Synthetic oligonucleotide
tccatgccgttcctgccgtt

SEQ ID NO: 772 - RNA, 80 nt, Homo sapiens
ugggaugagguaguagguuguauaguuuuagggucacacccaccacugggagauaacuauacaaucuacugucuuuccua

SEQ ID NO: 773 - RNA, 72 nt, Homo sapiens
agguugagguaguagguuguauaguuuagaauuacaucaagggagauaacuguacagccuccuagcuuuccu

SEQ ID NO: 774 - RNA, 74 nt, Homo sapiens
gggugagguaguagguuguauaguuuggggcucugcccugcuaugggauaacuauacaaucuacugucuuuccu

SEQ ID NO: 775 - RNA, 83 nt, Homo sapiens
cggggugagguaguagguugugugguuucagggcagugauguugccccucggaagauaacuauacaaccuacugccuucccug

SEQ ID NO: 776 - RNA, 84 nt, Homo sapiens
gcauccggguugagguaguagguuguaugguuuagaguuacacccugggaguuaacuguacaaccuucuagcuuuccuuggagc

SEQ ID NO: 777 - RNA, 87 nt, Homo sapiens
ccuaggaagagguaguagguugcauaguuuuagggcagggauuuugcccacaaggagguaacuauacgaccugcugccuuucuuagg

SEQ ID NO: 778 - RNA, 79 nt, Homo sapiens
cccgggcugagguaggagguuguauaguugaggaggacacccaaggagaucacuauacggccuccuagcuuuccccagg

SEQ ID NO: 779 - RNA, 87 nt, Homo sapiens
ucagagugagguaguagauuguauaguugugggguagugauuuuacccuguucaggagauaacuauacaaucuauugccuucccuga

SEQ ID NO: 780 - RNA, 83 nt, Homo sapiens
ugugggaugagguaguagauuguauaguuuuagggucauaccccaucuuggagauaacuauacagucuacugucuuucccacg

SEQ ID NO: 781 - RNA, 84 nt, Homo sapiens
aggcugagguaguaguuuguacaguuugagggucuaugauaccacccgguacaggagauaacuguacaggccacugccuugcca

SEQ ID NO: 782 - RNA, 84 nt, Homo sapiens
cuggcugagguaguaguuugugcuguuggucggguugugacauugcccgcuguggagauaacugcgcaagcuacugccuugcua

SEQ ID NO: 783 - RNA, 71 nt, Homo sapiens
ugggaaacauacuucuuuauaugcccauauggaccugcuaagcuauggaauguaaagaaguauguaucuca

SEQ ID NO: 784 - RNA, 85 nt, Homo sapiens
accuacucagaguacauacuucuuuauguacccauaugaacauacaaugcuauggaauguaaagaaguauguauuuuugguaggc

SEQ ID NO: 785 - RNA, 110 nt, Homo sapiens
uuggauguuggccuaguucuguguggaagacuagugauuuuguuguuuuuagauaacuaaaucgacaacaaaucacagucugccauauggcacaggccaugccucuacag

SEQ ID NO: 786 - RNA, 110 nt, Homo sapiens
cuggauacagaguggaccggcuggccccaucuggaagacuagugauuuuguuguugucuuacugcgcucaacaacaaaucccagucuaccuaauggugccagccaucgca

SEQ ID NO: 787 - RNA, 110 nt, Homo sapiens
agauuagaguggcuguggucuagugcuguguggaagacuagugauuuuguuguucugauguacuacgacaacaagucacagccggccucauagcgcagacucccuucgac

SEQ ID NO: 788 - RNA, 89 nt, Homo sapiens
cgggguugguuguuaucuuugguuaucuagcuguaugagugguguggagucuucauaaagcuagauaaccgaaaguaaaaauaacccca

SEQ ID NO: 789 - RNA, 87 nt, Homo sapiens
ggaagcgaguuguuaucuuugguuaucuagcuguaugaguguauuggucuucauaaagcuagauaaccgaaaguaaaaacuccuuca

SEQ ID NO: 790 - RNA, 90 nt, Homo sapiens
ggaggcccguuucucucuuugguuaucuagcuguaugagugccacagagccgucauaaagcuagauaaccgaaaguagaaaugauucuca

SEQ ID NO: 791 - RNA, 110 nt, Homo sapiens
gaucugucugucuucuguauauacccuguagauccgaauuuguguaaggaauuuuguggucacaaauucguaucuaggggaauauguaguugacauaaacacuccgcucu

SEQ ID NO: 792 - RNA, 110 nt, Homo sapiens
ccagagguuguaacguugucuauauauacccuguagaaccgaauuugugugguauccguauagucacagauucgauucuaggggaauauauggucgaugcaaaaacuuca

SEQ ID NO: 793 - RNA, 83 nt, Homo sapiens
ccuuggaguaaaguagcagcacauaaugguuuguggauuuugaaaaggugcaggccauauugugcugccucaaaaauacaagg

SEQ ID NO: 794 - RNA, 98 nt, Homo sapiens
uugaggccuuaaaguacuguagcagcacaucaugguuuacaugcuacagucaagaugcgaaucauuauuugcugcucuagaaauuuaaggaaauucau

SEQ ID NO: 795 - RNA, 89 nt, Homo sapiens
gucagcagugccuuagcagcacguaaauauuggcguuaagauucuaaaauuaucuccaguauuaacugugcugcugaaguaagguugac

SEQ ID NO: 796 - RNA, 81 nt, Homo sapiens
guuccacucuagcagcacguaaauauuggcguagugaaauauauauuaaacaccaauauuacugugcugcuuuagugugac

SEQ ID NO: 797 - RNA, 84 nt, Homo sapiens
gucagaauaaugucaaagugcuuacagugcagguagugauaugugcaucuacugcagugaaggcacuuguagcauuauggugac

SEQ ID NO: 798 - RNA, 71 nt, Homo sapiens
uguucuaaggugcaucuagugcagauagugaaguagauuagcaucuacugcccuaagugcuccuucuggca

SEQ ID NO: 799 - RNA, 71 nt, Homo sapiens
uguguuaaggugcaucuagugcaguuagugaagcagcuuagaaucuacugcccuaaaugccccuucuggca

SEQ ID NO: 800 - RNA, 82 nt, Homo sapiens
gcaguccucuguuaguuuugcauaguugcacuacaagaagaauguaguugugcaaaucuaugcaaaacugaugguggccugc

SEQ ID NO: 801 - RNA, 87 nt, Homo sapiens
cacuguucuaugguuaguuuugcagguuugcauccagcugugugauauucugcugugcaaauccaugcaaaacugacugugguagug

SEQ ID NO: 802 - RNA, 96 nt, Homo sapiens
acauugcuacuuacaauuaguuuugcagguuugcauuucagcguauauauguauauguggcugugcaaauccaugcaaaacugauugugauaaugu

SEQ ID NO: 803 - RNA, 71 nt, Homo sapiens
guagcacuaaagugcuuauagugcagguaguguuuaguuaucuacugcauuaugagcacuuaaaguacugc

SEQ ID NO: 804 - RNA, 69 nt, Homo sapiens
aguaccaaagugcucauagugcagguaguuuuggcaugacucuacuguaguaugggcacuuccaguacu

SEQ ID NO: 805 - RNA, 72 nt, Homo sapiens
ugucggguagcuuaucagacugauguugacuguugaaucucauggcaacaccagucgaugggcugucugaca

SEQ ID NO: 806 - RNA, 85 nt, Homo sapiens
ggcugagccgcaguaguucuucaguggcaagcuuuauguccugacccagcuaaagcugccaguugaagaacuguugcccucugcc

SEQ ID NO: 807 - RNA, 73 nt, Homo sapiens
ggccggcugggguuccuggggaugggauuugcuuccugucacaaaucacauugccagggauuuccaaccgacc

SEQ ID NO: 808 - RNA, 97 nt, Homo sapiens
cucaggugcucuggcugcuuggguuccuggcaugcugauuugugacuuaagauuaaaaucacauugccagggauuaccacgcaaccacgaccuuggc

SEQ ID NO: 809 - RNA, 100 nt, Homo sapiens
agugacuuuccaggugucacacagugaguggcauaaucagaguacaauuugagucaugcccauacaucacauugccagugauuacccaaggaaagugacg

SEQ ID NO: 810 - RNA, 68 nt, Homo sapiens
cuccggugccuacugagcugauaucaguucucauuuuacacacuggcucaguucagcaggaacaggag

SEQ ID NO: 811 - RNA, 73 nt, Homo sapiens
cucugccucccgugccuacugagcugaaacacaguugguuuguguacacuggcucaguucagcaggaacaggg

SEQ ID NO: 812 - RNA, 84 nt, Homo sapiens
ggccaguguugagaggcggagacuugggcaauugcuggacgcugcccugggcauugcacuugucucggucugacagugccggcc

SEQ ID NO: 813 - RNA, 77 nt, Homo sapiens
guggccucguucaaguaauccaggauaggcugugcaggucccaaugggccuauucuugguuacuugcacggggacgc

SEQ ID NO: 814 - RNA, 84 nt, Homo sapiens
ggcuguggcuggauucaaguaauccaggauaggcuguuuccaucugugaggccuauucuugauuacuuguuucuggaggcagcu

SEQ ID NO: 815 - RNA, 77 nt, Homo sapiens
ccgggacccaguucaaguaauucaggauagguugugugcuguccagccuguucuccauuacuuggcucggggaccgg

SEQ ID NO: 816 - RNA, 78 nt, Homo sapiens
cugaggagcagggcuuagcugcuugugagcaggguccacaccaagucguguucacaguggcuaaguuccgccccccag

SEQ ID NO: 817 - RNA, 97 nt, Homo sapiens
accucucuaacaaggugcagagcuuagcugauuggugaacagugauugguuuccgcuuuguucacaguggcuaaguucugcaccugaagagaaggug

SEQ ID NO: 818 - RNA, 86 nt, Homo sapiens
gguccuugcccucaaggagcucacagucuauugaguuaccuuucugacuuucccacuagauugugagcuccuggagggcaggcacu

SEQ ID NO: 819 - RNA, 64 nt, Homo sapiens
augacugauuucuuuugguguucagagucaauauaauuuucuagcaccaucugaaaucgguuau

SEQ ID NO: 820 - RNA, 81 nt, Homo sapiens
cuucaggaagcugguuucauauggugguuuagauuuaaauagugauugucuagcaccauuugaaaucaguguucuuggggg

SEQ ID NO: 821 - RNA, 81 nt, Homo sapiens
cuucuggaagcugguuucacaugguggcuuagauuuuuccaucuuuguaucuagcaccauuugaaaucaguguuuuaggag

SEQ ID NO: 822 - RNA, 88 nt, Homo sapiens
aucucuuacacaggcugaccgauuucuccugguguucagagucuguuuuugucuagcaccauuugaaaucgguuaugauguaggggga

SEQ ID NO: 823 - RNA, 71 nt, Homo sapiens
gcgacuguaaacauccucgacuggaagcugugaagccacagaugggcuuucagucggauguuugcagcugc

SEQ ID NO: 824 - RNA, 88 nt, Homo sapiens
accaaguuucaguucauguaaacauccuacacucagcuguaauacauggauuggcugggagguggauguuuacuucagcugacuugga

SEQ ID NO: 825 - RNA, 89 nt, Homo sapiens
accaugcuguaguguguguaaacauccuacacucucagcugugagcucaagguggcugggagaggguuguuuacuccuucugccaugga

SEQ ID NO: 826 - RNA, 72 nt, Homo sapiens
agauacuguaaacauccuacacucucagcuguggaaaguaagaaagcugggagaaggcuguuuacucuuucu

SEQ ID NO: 827 - RNA, 70 nt, Homo sapiens
guuguuguaaacauccccgacuggaagcuguaagacacagcuaagcuuucagucagauguuugcugcuac

SEQ ID NO: 828 - RNA, 92 nt, Homo sapiens
gggcagucuuugcuacuguaaacauccuugacuggaagcuguaagguguucagaggagcuuucagucggauguuuacagcggcaggcugcca

SEQ ID NO: 829 - RNA, 71 nt, Homo sapiens
ggagaggaggcaagaugcuggcauagcuguugaacugggaaccugcuaugccaacauauugccaucuuucc

SEQ ID NO: 830 - RNA, 70 nt, Homo sapiens
ggagauauugcacauuacuaaguugcauguugucacggccucaaugcaauuuagugugugugauauuuuc

SEQ ID NO: 831 - RNA, 69 nt, Homo sapiens
cuguggugcauuguaguugcauugcauguucuggugguacccaugcaauguuuccacagugcaucacag

SEQ ID NO: 832 - RNA, 96 nt, Homo sapiens
gcgggcggccccgcggugcauugcuguugcauugcacgugugugaggcgggugcagugccucggcagugcagcccggagccggccccuggcaccac

SEQ ID NO: 833 - RNA, 110 nt, Homo sapiens
ggccagcugugaguguuucuuuggcagugucuuagcugguuguugugagcaauaguaaggaagcaaucagcaaguauacugcccuagaagugcugcacguuguggggccc

SEQ ID NO: 834 - RNA, 84 nt, Homo sapiens
gugcucgguuuguaggcagugucauuagcugauuguacuguggugguuacaaucacuaacuccacugccaucaaaacaaggcac

SEQ ID NO: 835 - RNA, 77 nt, Homo sapiens
agucuaguuacuaggcaguguaguuagcugauugcuaauaguaccaaucacuaaccacacggccagguaaaaagauu

SEQ ID NO: 836 - RNA, 78 nt, Homo sapiens
cuuucuacacagguugggaucgguugcaaugcuguguuucuguaugguauugcacuugucccggccuguugaguuugg

SEQ ID NO: 837 - RNA, 75 nt, Homo sapiens
ucaucccuggguggggauuuguugcauuacuuguguucuauauaaaguauugcacuugucccggccuguggaaga

SEQ ID NO: 838 - RNA, 96 nt, Homo sapiens
cgggccccgggcgggcgggagggacgggacgcggugcaguguuguuuuuucccccgccaauauugcacucgucccggccuccggcccccccggccc

SEQ ID NO: 839 - RNA, 80 nt, Homo sapiens
cugggggcuccaaagugcuguucgugcagguagugugauuacccaaccuacugcugagcuagcacuucccgagcccccgg

SEQ ID NO: 840 - RNA, 81 nt, Homo sapiens
aacacagugggcacucaauaaaugucuguugaauugaaaugcguuacauucaacggguauuuauugagcacccacucugug

SEQ ID NO: 841 - RNA, 78 nt, Homo sapiens
uggccgauuuuggcacuagcacauuuuugcuugugucucuccgcucugagcaaucaugugcagugccaauaugggaaa

SEQ ID NO: 842 - RNA, 119 nt, Homo sapiens
aggauucugcucaugccagggugagguaguaaguuguauuguugugggguagggauauuaggccccaauuagaagauaacuauacaacuuacuacuuucccugguguguggcauauuca

SEQ ID NO: 843 - RNA, 81 nt, Homo sapiens
cccauuggcauaaacccguagauccgaucuuguggugaaguggaccgcacaagcucgcuucuaugggucugugucagugug

SEQ ID NO: 844 - RNA, 70 nt, Homo sapiens
ggcacccacccguagaaccgaccuugcggggccuucgccgcacacaagcucgugucuguggguccguguc

SEQ ID NO: 845 - RNA, 80 nt, Homo sapiens
ccuguugccacaaacccguagauccgaacuugugguauuaguccgcacaagcuuguaucuauagguaugugucuguuagg

SEQ ID NO: 846 - RNA, 75 nt, Homo sapiens
ugcccuggcucaguuaucacagugcugaugcugucuauucuaaagguacaguacugugauaacugaaggauggca

SEQ ID NO: 847 - RNA, 79 nt, Homo sapiens
acuguccuuuuucgguuaucaugguaccgaugcuguauaucugaaagguacaguacugugauaacugaagaaugguggu

SEQ ID NO: 848 - RNA, 78 nt, Homo sapiens
uacugcccucggcuucuuuacagugcugccuuguugcauauggaucaagcagcauuguacagggcuaugaaggcauug

SEQ ID NO: 849 - RNA, 78 nt, Homo sapiens
uugugcuuucagcuucuuuacagugcugccuuguagcauucaggucaagcagcauuguacagggcuaugaaagaacca

SEQ ID NO: 850 - RNA, 62 nt, Homo sapiens
ucauagcccuguacaaugcugcuugauccauaugcaacaaggcagcacuguaaagaagccga

SEQ ID NO: 851 - RNA, 62 nt, Homo sapiens
ucauagcccuguacaaugcugcuugaccugaaugcuacaaggcagcacuguaaagaagcuga

SEQ ID NO: 852 - RNA, 81 nt, Homo sapiens
ugugcaucguggucaaaugcucagacuccugugguggcugcucaugcaccacggauguuugagcaugugcuacggugucua

SEQ ID NO: 853 - RNA, 81 nt, Homo sapiens
ugugcaucguggucaaaugcucagacuccugugguggcugcuuaugcaccacggauguuugagcaugugcuauggugucua

SEQ ID NO: 854 - RNA, 81 nt, Homo sapiens
ccuuggccauguaaaagugcuuacagugcagguagcuuuuugagaucuacugcaauguaagcacuucuuacauuaccaugg

SEQ ID NO: 855 - RNA, 82 nt, Homo sapiens
ccugccggggcuaaagugcugacagugcagauagugguccucuccgugcuaccgcacuguggguacuugcugcuccagcagg

SEQ ID NO: 856 - RNA, 81 nt, Homo sapiens
cucucugcuuucagcuucuuuacaguguugccuuguggcauggaguucaagcagcauuguacagggcuaucaaagcacaga

SEQ ID NO: 857 - RNA, 85 nt, Homo sapiens
ccuuagcagagcuguggagugugacaaugguguuugugucuaaacuaucaaacgccauuaucacacuaaauagcuacugcuaggc

SEQ ID NO: 858 - RNA, 85 nt, Homo sapiens
aggccucucucuccguguucacagcggaccuugauuuaaauguccauacaauuaaggcacgcggugaaugccaagaauggggcug

SEQ ID NO: 859 - RNA, 109 nt, Homo sapiens
aucaagauuagaggcucugcucuccguguucacagcggaccuugauuuaaugucauacaauuaaggcacgcggugaaugccaagagcggagccuacggcugcacuugaa

SEQ ID NO: 860 - RNA, 87 nt, Homo sapiens
ugagggccccucugcguguucacagcggaccuugauuuaaugucuauacaauuaaggcacgcggugaaugccaagagaggcgccucc

SEQ ID NO: 861 - RNA, 86 nt, Homo sapiens
ugccagucucuaggucccugagacccuuuaaccugugaggacauccagggucacaggugagguucuugggagccuggcgucuggcc

SEQ ID NO: 862 - RNA, 88 nt, Homo sapiens
ugcgcuccucucagucccugagacccuaacuugugauguuuaccguuuaaauccacggguuaggcucuugggagcugcgagucgugcu

SEQ ID NO: 863 - RNA, 89 nt, Homo sapiens
accagacuuuuccuagucccugagacccuaacuugugagguauuuuaguaacaucacaagucaggcucuugggaccuaggcggagggga

SEQ ID NO: 864 - RNA, 85 nt, Homo sapiens
cgcuggcgacgggacauuauuacuuuugguacgcgcugugacacuucaaacucguaccgugaguaauaaugcgccguccacggca

SEQ ID NO: 865 - RNA, 97 nt, Homo sapiens
ugugaucacugucuccagccugcugaagcucagagggcucugauucagaaagaucaucggauccgucugagcuuggcuggucggaagucucaucauc

SEQ ID NO: 866 - RNA, 82 nt, Homo sapiens
ugagcuguuggauucggggccguagcacugucugagagguuuacauuucucacagugaaccggucucuuuuucagcugcuuc

SEQ ID NO: 867 - RNA, 84 nt, Homo sapiens
ugugcagugggaaggggggccgauacacuguacgagagugaguagcaggucucacagugaaccggucucuuucccuacuguguc

SEQ ID NO: 868 - RNA, 72 nt, Homo sapiens
ggaucuuuuugcggucugggcuugcuguuccucucaacaguagucaggaagcccuuaccccaaaaaguaucu

SEQ ID NO: 869 - RNA, 90 nt, Homo sapiens
ugcccuucgcgaaucuuuuugcggucugggcuugcuguacauaacucaauagccggaagcccuuaccccaaaaagcauuugcggagggcg

SEQ ID NO: 870 - RNA, 89 nt, Homo sapiens
ugcugcuggccagagcucuuuucacauugugcuacugucugcaccugucacuagcagugcaauguuaaaagggcauuggccguguagug

SEQ ID NO: 871 - RNA, 82 nt, Homo sapiens
ggccugcccgacacucuuucccuguugcacuacuauaggccgcugggaagcagugcaaugaugaaagggcaucggucagguc

SEQ ID NO: 872 - RNA, 101 nt, Homo sapiens
ccgcccccgcgucuccagggcaaccguggcuuucgauuguuacugugggaacuggagguaacagucuacagccauggucgccccgcagcacgcccacgcgc

SEQ ID NO: 873 - RNA, 88 nt, Homo sapiens
acaaugcuuugcuagagcugguaaaauggaaccaaaucgccucuucaauggauuugguccccuucaaccagcuguagcuaugcauuga

SEQ ID NO: 874 - RNA, 102 nt, Homo sapiens
gggagccaaaugcuuugcuagagcugguaaaauggaaccaaaucgacuguccaauggauuugguccccuucaaccagcuguagcugugcauugauggcgccg

SEQ ID NO: 875 - RNA, 119 nt, Homo sapiens
ccucagaagaaagaugcccccugcucuggcuggucaaacggaaccaaguccgucuuccugagagguuugguccccuucaaccagcuacagcagggcuggcaaugcccaguccuuggaga

SEQ ID NO: 876 - RNA, 73 nt, Homo sapiens
cagggugugugacugguugaccagaggggcaugcacuguguucacccugugggccaccuagucaccaacccuc

SEQ ID NO: 877 - RNA, 90 nt, Homo sapiens
aggccucgcuguucucuauggcuuuuuauuccuaugugauucuacugcucacucauauagggauuggagccguggcgcacggcggggaca

SEQ ID NO: 878 - RNA, 100 nt, Homo sapiens
agauaaauucacucuagugcuuuauggcuuuuuauuccuaugugauaguaauaaagucucauguagggauggaagccaugaaauacauugugaaaaauca

SEQ ID NO: 879 - RNA, 97 nt, Homo sapiens
cacucugcuguggccuauggcuuuucauuccuaugugauugcugucccaaacucauguagggcuaaaagccaugggcuacagugaggggcgagcucc

SEQ ID NO: 880 - RNA, 82 nt, Homo sapiens
ugagcccucggaggacuccauuuguuuugaugauggauucuuaugcuccaucaucgucucaaaugagucuucagaggguucu

SEQ ID NO: 881 - RNA, 102 nt, Homo sapiens
gguccucugacucucuucggugacggguauucuuggguggauaauacggauuacguuguuauugcuuaagaauacgcguagucgaggagaguaccagcggca

SEQ ID NO: 882 - RNA, 99 nt, Homo sapiens
cccuggcauggugugguggggcagcugguguugugaaucaggccguugccaaucagagaacggcuacuucacaacaccagggccacaccacacuacagg

SEQ ID NO: 883 - RNA, 84 nt, Homo sapiens
cguugcugcagcugguguugugaaucaggccgacgagcagcgcauccucuuacccggcuauuucacgacaccaggguugcauca

SEQ ID NO: 884 - RNA, 68 nt, Homo sapiens
guguauucuacagugcacgugucuccaguguggcucggaggcuggagacgcggcccuguuggaguaac

SEQ ID NO: 885 - RNA, 100 nt, Homo sapiens
ugugucucucucuguguccugccagugguuuuacccuaugguagguuacgucaugcuguucuaccacaggguagaaccacggacaggauaccggggcacc

SEQ ID NO: 886 - RNA, 95 nt, Homo sapiens
cggccggcccuggguccaucuuccaguacaguguuggauggucuaauugugaagcuccuaacacugucugguaaagauggcucccggguggguuc

SEQ ID NO: 887 - RNA, 87 nt, Homo sapiens
gacagugcagucacccauaaaguagaaagcacuacuaacagcacuggaggguguaguguuuccuacuuuauggaugaguguacugug

SEQ ID NO: 888 - RNA, 106 nt, Homo sapiens
gcgcagcgcccugucucccagccugaggugcagugcugcaucucuggucaguugggagucugagaugaagcacuguagcucaggaagagagaaguuguucugcagc

SEQ ID NO: 889 - RNA, 86 nt, Homo sapiens
uggggcccuggcugggauaucaucauauacuguaaguuugcgaugagacacuacaguauagaugauguacuaguccgggcaccccc

SEQ ID NO: 890 - RNA, 88 nt, Homo sapiens
caccuuguccucacgguccaguuuucccaggaaucccuuagaugcuaagauggggauuccuggaaauacuguucuugaggucaugguu

SEQ ID NO: 891 - RNA, 99 nt, Homo sapiens
ccgauguguauccucagcuuugagaacugaauuccauggguugugucagugucagaccucugaaauucaguucuucagcugggauaucucugucaucgu

SEQ ID NO: 892 - RNA, 73 nt, Homo sapiens
ccuggcacugagaacugaauuccauaggcugugagcucuagcaaugcccuguggacucaguucuggugcccgg

SEQ ID NO: 893 - RNA, 72 nt, Homo sapiens
aaucuaaagacaacauuucugcacacacaccagacuauggaagccaguguguggaaaugcuucugcuagauu

SEQ ID NO: 894 - RNA, 80 nt, Homo sapiens
uauaaaucuaguggaaacauuucugcacaaacuagauucuggacaccagugugcggaaaugcuucugcuacauuuuuagg

SEQ ID NO: 895 - RNA, 68 nt, Homo sapiens
gaggcaaaguucugagacacuccgacucugaguaugauagaagucagugcacuacagaacuuugucuc

SEQ ID NO: 896 - RNA, 99 nt, Homo sapiens
caagcacgauuagcauuugaggugaaguucuguuauacacucaggcuguggcucucugaaagucagugcaucacagaacuuugucucgaaagcuuucua

SEQ ID NO: 897 - RNA, 89 nt, Homo sapiens
gccggcgcccgagcucuggcuccgugucuucacucccgugcuuguccgaggagggagggagggacgggggcugugcuggggcagcugga

SEQ ID NO: 898 - RNA, 84 nt, Homo sapiens
cuccccauggcccugucucccaacccuuguaccagugcugggcucagacccugguacaggccugggggacagggaccuggggac

SEQ ID NO: 899 - RNA, 90 nt, Homo sapiens
uuuccugcccucgaggagcucacagucuaguaugucucauccccuacuagacugaagcuccuugaggacagggauggucauacucaccuc

SEQ ID NO: 900 - RNA, 96 nt, Homo sapiens
accucugaugugucagucucucuucagggcucccgagacacagaaacagacaccugcccucgaggagcucacagucuagacaaacaaacccagggu

SEQ ID NO: 901 - RNA, 87 nt, Homo sapiens
ugucccccccggcccagguucugugauacacuccgacucgggcucuggagcagucagugcaugacagaacuugggcccggaaggacc

SEQ ID NO: 902 - RNA, 90 nt, Homo sapiens
cucacagcugccagugucauuuuugugaucugcagcuaguauucucacuccaguugcauagucacaaaagugaucauuggcagguguggc

SEQ ID NO: 903 - RNA, 87 nt, Homo sapiens
agcgguggccagugucauuuuugugauguugcagcuaguaauaugagcccaguugcauagucacaaaagugaucauuggaaacugug

SEQ ID NO: 904 - RNA, 84 nt, Homo sapiens
gugguacuugaagauagguuauccguguugccuucgcuuuauuugugacgaaucauacacgguugaccuauuuuucaguaccaa

SEQ ID NO: 905 - RNA, 65 nt, Homo sapiens
cuguuaaugcuaaucgugauagggguuuuugccuccaacugacuccuacauauuagcauuaacag

SEQ ID NO: 906 - RNA, 110 nt, Homo sapiens
ugaguuuugagguugcuucagugaacauucaacgcugucggugaguuuggaauuaaaaucaaaaccaucgaccguugauuguacccuauggcuaaccaucaucuacucca

SEQ ID NO: 907 - RNA, 110 nt, Homo sapiens
agaagggcuaucaggccagccuucagaggacuccaaggaacauucaacgcugucggugaguuugggauuugaaaaaaccacugaccguugacuguaccuugggguccuua

SEQ ID NO: 908 - RNA, 110 nt, Homo sapiens
ccugugcagagauuauuuuuuaaaaggucacaaucaacauucauugcugucgguggguugaacuguguggacaagcucacugaacaaugaaugcaacuguggccccgcuu

SEQ ID NO: 909 - RNA, 89 nt, Homo sapiens
cugauggcugcacucaacauucauugcugucgguggguuugagucugaaucaacucacugaucaaugaaugcaaacugcggaccaaaca

SEQ ID NO: 910 - RNA, 110 nt, Homo sapiens
cggaaaauuugccaaggguuugggggaacauucaaccugucggugaguuugggcagcucaggcaaaccaucgaccguugaguggacccugaggccuggaauugccauccu

SEQ ID NO: 911 - RNA, 137 nt, Homo sapiens
guccccuccccuaggccacagccgaggucacaaucaacauucauuguugucgguggguugugaggacugaggccagacccaccgggggaugaaugucacuguggcugggccagacacggcuuaaggggaauggggac

SEQ ID NO: 912 - RNA, 110 nt, Homo sapiens
gagcugcuugccuccccccguuuuuggcaaugguagaacucacacuggugagguaacaggauccggugguucuagacuugccaacuauggggcgaggacucagccggcac

SEQ ID NO: 913 - RNA, 110 nt, Homo sapiens
ccgcagagugugacuccuguucuguguauggcacugguagaauucacugugaacagucucagucagugaauuaccgaagggccauaaacagagcagagacagauccacga

SEQ ID NO: 914 - RNA, 84 nt, Homo sapiens
ccagucacguccccuuaucacuuuuccagcccagcuuugugacuguaaguguuggacggagaacugauaaggguaggugauuga

SEQ ID NO: 915 - RNA, 82 nt, Homo sapiens
agggggcgagggauuggagagaaaggcaguuccugaugguccccuccccaggggcuggcuuuccucugguccuucccuccca

SEQ ID NO: 916 - RNA, 86 nt, Homo sapiens
ugcuuguaacuuuccaaagaauucuccuuuugggcuuucugguuuuauuuuaagcccaaaggugaauuuuuugggaaguuugagcu

SEQ ID NO: 917 - RNA, 109 nt, Homo sapiens
ggucgggcucaccaugacacagugugagaccucgggcuacaacacaggacccgggcgcugcucugaccccucgugucuuguguugcagccggagggacgcagguccgca

SEQ ID NO: 918 - RNA, 86 nt, Homo sapiens
ugcucccucucucacaucccuugcaugguggagggugagcuuucugaaaaccccucccacaugcaggguuugcaggauggcgagcc

SEQ ID NO: 919 - RNA, 85 nt, Homo sapiens
ugcaggccucugugugauauguuugauauauuagguuguuauuuaauccaacuauauaucaaacauauuccuacagugucuugcc

SEQ ID NO: 920 - RNA, 79 nt, Homo sapiens
ugcuucugugugauauguuugauauuggguuguuuaauuaggaaccaacuaaaugucaaacauauucuuacagcagcag

SEQ ID NO: 921 - RNA, 92 nt, Homo sapiens
cggcuggacagcgggcaacggaaucccaaaagcagcuguugucuccagagcauuccagcugcgcuuggauuucguccccugcucuccugccu

SEQ ID NO: 922 - RNA, 110 nt, Homo sapiens
gccgagaccgagugcacagggcucugaccuaugaauugacagccagugcucucgucuccccucuggcugccaauuccauaggucacagguauguucgccucaaugccagc

SEQ ID NO: 923 - RNA, 88 nt, Homo sapiens
cgaggaugggagcugagggcugggucuuugcgggcgagaugagggugucggaucaacuggccuacaaagucccaguucucggcccccg

SEQ ID NO: 924 - RNA, 83 nt, Homo sapiens
guggucucagaaucgggguuuugagggcgagaugaguuuauguuuuauccaacuggcccucaaagucccgcuuuuggggucau

SEQ ID NO: 925 - RNA, 85 nt, Homo sapiens
augguguuaucaaguguaacagcaacuccauguggacuguguaccaauuuccaguggagaugcuguuacuuuugaugguuaccaa

SEQ ID NO: 926 - RNA, 85 nt, Homo sapiens
ugguucccgcccccuguaacagcaacuccauguggaagugcccacugguuccaguggggcugcuguuaucuggggcgagggccag

SEQ ID NO: 927 - RNA, 87 nt, Homo sapiens
agcuucccuggcucuagcagcacagaaauauuggcacagggaagcgagucugccaauauuggcugugcugcuccaggcaggguggug

SEQ ID NO: 928 - RNA, 70 nt, Homo sapiens
gugaauuagguaguuucauguuguugggccuggguuucugaacacaacaacauuaaaccacccgauucac

SEQ ID NO: 929 - RNA, 110 nt, Homo sapiens
ugcucgcucagcugaucuguggcuuagguaguuucauguuguugggauugaguuuugaacucggcaacaagaaacugccugaguuacaucagucgguuuucgucgagggc

SEQ ID NO: 930 - RNA, 84 nt, Homo sapiens
acuggucggugauuuagguaguuuccuguuguugggauccaccuuucucucgacagcacgacacugccuucauuacuucaguug

SEQ ID NO: 931 - RNA, 75 nt, Homo sapiens
ggcugugccggguagagagggcagugggagguaagagcucuucacccuucaccaccuucuccacccagcauggcc

SEQ ID NO: 932 - RNA, 62 nt, Homo sapiens
ucauugguccagaggggagauagguuccugugauuuuuccuucuucucuauagaauaaauga

SEQ ID NO: 933 - RNA, 71 nt, Homo sapiens
gccaacccaguguucagacuaccuguucaggaggcucucaauguguacaguagucugcacauugguuaggc

SEQ ID NO: 934 - RNA, 110 nt, Homo sapiens
aggaagcuucuggagauccugcuccgucgccccaguguucagacuaccuguucaggacaaugccguuguacaguagucugcacauugguuagacugggcaagggagagca

SEQ ID NO: 935 - RNA, 110 nt, Homo sapiens
ccagaggacaccuccacuccgucuacccaguguuuagacuaucuguucaggacucccaaauuguacaguagucugcacauugguuaggcugggcuggguuagacccucgg

SEQ ID NO: 936 - RNA, 90 nt, Homo sapiens
ccgggccccugugagcaucuuaccggacagugcuggauuucccagcuugacucuaacacugucugguaacgauguucaaaggugacccgc

SEQ ID NO: 937 - RNA, 95 nt, Homo sapiens
ccagcucgggcagccguggccaucuuacugggcagcauuggauggagucaggucucuaauacugccugguaaugaugacggcggagcccugcacg

SEQ ID NO: 938 - RNA, 68 nt, Homo sapiens
cccucgucuuacccagcaguguuugggugcgguugggagucucuaauacugccggguaaugauggagg

SEQ ID NO: 939 - RNA, 110 nt, Homo sapiens
cgccucagagccgcccgccguuccuuuuuccuaugcauauacuucuuugaggaucuggccuaaagagguauagggcaugggaaaacggggcggucggguccuccccagcg

SEQ ID NO: 940 - RNA, 110 nt, Homo sapiens
guguuggggacucgcgcgcuggguccagugguucuuaacaguucaacaguucuguagcgcaauugugaaauguuuaggaccacuagacccggcgggcgcggcgacagcga

SEQ ID NO: 941 - RNA, 110 nt, Homo sapiens
ggcuacagucuuucuucaugugacucguggacuucccuuugucauccuaugccugagaauauaugaaggaggcugggaaggcaaagggacguucaauugucaucacuggc

SEQ ID NO: 942 - RNA, 110 nt, Homo sapiens
aaagauccucagacaauccaugugcuucucuuguccuucauuccaccggagucugucucauacccaaccagauuucaguggagugaaguucaggaggcauggagcugaca

SEQ ID NO: 943 - RNA, 86 nt, Homo sapiens
ugcuucccgaggccacaugcuucuuuauauccccauauggauuacuuugcuauggaauguaaggaagugugugguuucggcaagug

SEQ ID NO: 944 - RNA, 71 nt, Homo sapiens
ugacgggcgagcuuuuggcccggguuauaccugaugcucacguauaagacgagcaaaaagcuuguugguca

SEQ ID NO: 945 - RNA, 77 nt, Homo sapiens
ccucucagggaagcuuuuugcucgaauuauguuucugauccgaauauaagacgaacaaaagguuugucugagggcag

SEQ ID NO: 946 - RNA, 110 nt, Homo sapiens
acccggcagugccuccaggcgcagggcagccccugcccaccgcacacugcgcugccccagacccacugugcgugugacagcggcugaucugugccugggcagcgcgaccc

SEQ ID NO: 947 - RNA, 110 nt, Homo sapiens
ucaccuggccaugugacuugugggcuucccuuugucauccuucgccuagggcucugagcagggcagggacagcaaaggggugcucaguugucacuucccacagcacggag

SEQ ID NO: 948 - RNA, 110 nt, Homo sapiens
cggggcaccccgcccggacagcgcgccggcaccuuggcucuagacugcuuacugcccgggccgcccucaguaacagucuccagucacggccaccgacgccuggccccgcc

SEQ ID NO: 949 - RNA, 110 nt, Homo sapiens
ggccuggcuggacagaguugucaugugucugccugucuacacuugcugugcagaacauccgcucaccuguacagcaggcacagacaggcagucacaugacaacccagccu

SEQ ID NO: 950 - RNA, 110 nt, Homo sapiens
aucauucagaaaugguauacaggaaaaugaccuaugaauugacagacaauauagcugaguuugucugucauuucuuuaggccaauauucuguaugacugugcuacuucaa

SEQ ID NO: 951 - RNA, 110 nt, Homo sapiens
gauggcugugaguuggcuuaaucucagcuggcaacugugagauguucauacaaucccucacaguggucucugggauuaugcuaaacagagcaauuuccuagcccucacga

SEQ ID NO: 952 - RNA, 82 nt, Homo sapiens
gcagacuggaaaaucucugcaggcaaaugugaugucacugaggaaaucacacacuuacccguagagauucuacagucugaca

SEQ ID NO: 953 - RNA, 110 nt, Homo sapiens
aguauaauuauuacauaguuuuugaugucgcagauacugcaucaggaacugauuggauaagaaucagucaccaucaguuccuaaugcauugccuucagcaucuaaacaag

SEQ ID NO: 954 - RNA, 110 nt, Homo sapiens
gugauaauguagcgagauuuucuguugugcuugaucuaaccaugugguugcgagguaugaguaaaacaugguuccgucaagcaccauggaacgucacgcagcuuucuaca

SEQ ID NO: 955 - RNA, 110 nt, Homo sapiens
gaccagucgcugcggggcuuuccuuugugcuugaucuaaccaugugguggaacgauggaaacggaacaugguucugucaagcaccgcggaaagcaccgugcucuccugca

SEQ ID NO: 956 - RNA, 110 nt, Homo sapiens
ccgccccgggccgcggcuccugauuguccaaacgcaauucucgagucuauggcuccggccgagaguugagucuggacgucccgagccgccgcccccaaaccucgagcggg

SEQ ID NO: 957 - RNA, 97 nt, Homo sapiens
acucaggggcuucgccacugauuguccaaacgcaauucuuguacgagucugcggccaaccgagaauuguggcuggacaucuguggcugagcuccggg

SEQ ID NO: 958 - RNA, 110 nt, Homo sapiens
ugaacauccaggucuggggcaugaaccuggcauacaauguagauuucuguguucguuaggcaacagcuacauugucugcuggguuucaggcuaccuggaaacauguucuc

SEQ ID NO: 959 - RNA, 110 nt, Homo sapiens
gcugcuggaagguguagguacccucaauggcucaguagccaguguagauccugucuuucguaaucagcagcuacaucuggcuacugggucucugauggcaucuucuagcu

SEQ ID NO: 960 - RNA, 110 nt, Homo sapiens
ccuggccuccugcagugccacgcuccguguauuugacaagcugaguuggacacuccaugugguagagugucaguuugucaaauaccccaagugcggcacaugcuuaccag

SEQ ID NO: 961 - RNA, 81 nt, Homo sapiens
gggcuuucaagucacuagugguuccguuuaguagaugauugugcauuguuucaaaauggugcccuagugacuacaaagccc

SEQ ID NO: 962 - RNA, 80 nt, Homo sapiens
aggacccuuccagagggcccccccucaauccuguugugccuaauucagaggguuggguggaggcucuccugaagggcucu

SEQ ID NO: 963 - RNA, 66 nt, Homo sapiens
uguauguaugugugcaugugcauguauguguauauacauauauauguauuauguacucauauauca

SEQ ID NO: 964 - RNA, 88 nt, Homo sapiens
ucaggucuucagcagaagcagggagguucucccagugguuuuccuugacugugaggaacuagccugcugcuuugcucaggagugagcu

SEQ ID NO: 965 - RNA, 63 nt, Homo sapiens
aagaaaugguuuaccgucccacauacauuuugaauauguaugugggaugguaaaccgcuucuu

SEQ ID NO: 966 - RNA, 83 nt, Homo sapiens
ugcuacuugaagagagguaauccuucacgcauuugcuuuacuugcaaugauuauacaagggcagacucucucuggggagcaaa

SEQ ID NO: 967 - RNA, 86 nt, Homo sapiens
acugcuaacgaaugcucugacuuuauugcacuacuguacuuuacagcuagcagugcaauaguauugucaaagcaucugaaagcagg

SEQ ID NO: 968 - RNA, 78 nt, Homo sapiens
gccgcaggugcucugacgagguugcacuacugugcucugagaagcagugcaaugauauugucaaagcaucugggacca

SEQ ID NO: 969 - RNA, 69 nt, Homo sapiens
ccaccacuuaaacguggauguacuugcuuugaaacuaaagaaguaagugcuuccauguuuuggugaugg

SEQ ID NO: 970 - RNA, 73 nt, Homo sapiens
gcucccuucaacuuuaacauggaagugcuuucugugacuuuaaaaguaagugcuuccauguuuuaguaggagu

SEQ ID NO: 971 - RNA, 68 nt, Homo sapiens
ccuuugcuuuaacauggggguaccugcugugugaaacaaaaguaagugcuuccauguuucaguggagg

SEQ ID NO: 972 - RNA, 68 nt, Homo sapiens
ccucuacuuuaacauggaggcacuugcugugacaugacaaaaauaagugcuuccauguuugagugugg

SEQ ID NO: 973 - RNA, 72 nt, Homo sapiens
uuggguaagugcuuccaugcuucaguuuccuuacugguaagauggauguaguaauagcaccuaccuuauaga

SEQ ID NO: 974 - RNA, 51 nt, Homo sapiens
ucuguguaaaccuggcaauuuucacuuaauugcuuccauguuuauaaaaga

SEQ ID NO: 975 - RNA, 82 nt, Homo sapiens
gcuucgcuccccuccgccuucucuucccgguucuucccggagucgggaaaagcuggguugagagggcgaaaaaggaugaggu

SEQ ID NO: 976 - RNA, 79 nt, Homo sapiens
aauuaaucccucucuuucuaguucuuccuagagugaggaaaagcuggguugagagggcaaacaaauuaacuaauuaauu

SEQ ID NO: 977 - RNA, 138 nt, Homo sapiens
uguuauuuuuugucuucuaccuaagaauucugucucuuaggcuuucucuucccagauuucccaaaguugggaaaagcuggguugagagggcaaaaggaaaaaaaaagaauucugucucugacauaauuagauagggaa

SEQ ID NO: 978 - RNA, 88 nt, Homo sapiens
uuugcauuaaaaaugaggccuucucuucccaguucuucccagagucaggaaaagcuggguugagaggguagaaaaaaaaugauguagg

SEQ ID NO: 979 - RNA, 50 nt, Homo sapiens
cuucucuuuccaguucuucccagaauugggaaaagcuggguugagagggu

SEQ ID NO: 980 - RNA, 48 nt, Homo sapiens
uucucgucccaguucuucccaaaguugagaaaagcuggguugagagga

SEQ ID NO: 981 - RNA, 48 nt, Homo sapiens
uucucuucccaguucuucuuggagucaggaaaagcuggguugagagga

SEQ ID NO: 982 - RNA, 53 nt, Homo sapiens
gccuucucuucccaguucuuccuggagucggggaaaagcuggguugagaaggu

SEQ ID NO: 983 - RNA, 86 nt, Homo sapiens
uugguacuuggagagaggugguccguggcgcguucgcuuuauuuauggcgcacauuacacggucgaccucuuugcaguaucuaauc

SEQ ID NO: 984 - RNA, 82 nt, Homo sapiens
ugguacucggagggagguuguccguggugaguucgcauuauuuaaugaugcccaauacacggucgaccucuuuucgguauca

SEQ ID NO: 985 - RNA, 83 nt, Homo sapiens
cugacuaugccuccccgcauccccuagggcauugguguaaagcuggagacccacugccccaggugcugcuggggguuguaguc

SEQ ID NO: 986 - RNA, 98 nt, Homo sapiens
auacagugcuugguuccuaguagguguccaguaaguguuugugacauaauuuguuuauugaggaccuccuaucaaucaagcacugugcuaggcucugg

SEQ ID NO: 987 - RNA, 95 nt, Homo sapiens
cucaucugucuguugggcuggaggcagggccuuugugaaggcggguggugcucagaucgccucugggcccuuccuccagccccgaggcggauuca

SEQ ID NO: 988 - RNA, 75 nt, Homo sapiens
uggagugggggggcaggaggggcucagggagaaagugcauacagccccuggcccucucugcccuuccguccccug

SEQ ID NO: 989 - RNA, 80 nt, Homo sapiens
gguaccugaagagagguuuucuggguuucuguuucuuuaaugaggacgaaacacaccugguuaaccucuuuuccaguauc

SEQ ID NO: 990 - RNA, 84 nt, Homo sapiens
gugguaccugaagagagguuuucuggguuucuguuucuuuauugaggacgaaacacaccugguuaaccucuuuuccaguaucaa

SEQ ID NO: 991 - RNA, 94 nt, Homo sapiens
cuuuggcgaucacugccucucugggccugugucuuaggcucugcaagaucaaccgagcaaagcacacggccugcagagaggcagcgcucugccc

SEQ ID NO: 992 - RNA, 94 nt, Homo sapiens
gaguuugguuuuguuuggguuuguucuagguauggucccagggaucccagaucaaaccaggccccugggccuauccuagaaccaaccuaagcuc

SEQ ID NO: 993 - RNA, 94 nt, Homo sapiens
uguuuugagcgggggucaagagcaauaacgaaaaauguuugucauaaaccguuuuucauuauugcuccugaccuccucucauuugcuauauuca

SEQ ID NO: 994 - RNA, 93 nt, Homo sapiens
guagucaguaguuggggggugggaacggcuucauacaggaguugaugcacaguuauccagcuccuauaugaugccuuucuucauccccuucaa

SEQ ID NO: 995 - RNA, 67 nt, Homo sapiens
ucuccaacaauauccuggugcugagugaugacucaggcgacuccagcaucagugauuuuguugaaga

SEQ ID NO: 996 - RNA, 94 nt, Homo sapiens
cggggcggccgcucucccuguccuccaggagcucacgugugccugccugugagcgccucgacgacagagccggcgccugccccagugucugcgc

SEQ ID NO: 997 - RNA, 95 nt, Homo sapiens
uuguaccuggugugauuauaaagcaaugagacugauugucauaugucguuugugggauccgucucaguuacuuuauagccauaccugguaucuua

SEQ ID NO: 998 - RNA, 99 nt, Homo sapiens
gaaacugggcucaaggugaggggugcuaucugugauugagggacaugguuaauggaauugucucacacagaaaucgcacccgucaccuuggccuacuua

SEQ ID NO: 999 - RNA, 98 nt, Homo sapiens
acccaaacccuaggucugcugacuccuaguccagggcucgugauggcuggugggcccugaacgaggggucuggaggccuggguuugaauaucgacagc

SEQ ID NO: 1000 - RNA, 95 nt, Homo sapiens
ggucucuguguugggcgucugucugcccgcaugccugccucucuguugcucugaaggaggcaggggcugggccugcagcugccugggcagagcgg

SEQ ID NO: 1001 - RNA, 72 nt, Homo sapiens
ggagcuuaucagaaucuccagggguacuuuauaauuucaaaaagucccccaggugugauucugauuugcuuc

SEQ ID NO: 1002 - RNA, 65 nt, Homo sapiens
cuugaauccuuggaaccuaggugugagugcuauuucagugcaacacaccuauucaaggauucaaa

SEQ ID NO: 1003 - RNA, 75 nt, Homo sapiens
uguugucggguggaucacgaugcaauuuugaugaguaucauaggagaaaaauugcacgguauccaucuguaaacc

SEQ ID NO: 1004 - RNA, 87 nt, Homo sapiens
accgcagggaaaaugagggacuuuugggggcagauguguuuccauuccacuaucauaaugccccuaaaaauccuuauugcucuugca

SEQ ID NO: 1005 - RNA, 111 nt, Homo sapiens
agaguguucaaggacagcaagaaaaaugagggacuuucaggggcagcuguguuuucugacucagucauaaugccccuaaaaauccuuauuguucuugcagugugcaucggg

SEQ ID NO: 1006 - RNA, 68 nt, Homo sapiens
ccauuacuguugcuaauaugcaacucuguugaauauaaauuggaauugcacuuuagcaauggugaugg

SEQ ID NO: 1007 - RNA, 70 nt, Homo sapiens
uugaagggagaucgaccguguuauauucgcuuuauugacuucgaauaauacaugguugaucuuuucucag

SEQ ID NO: 1008 - RNA, 75 nt, Homo sapiens
agacagagaagccaggucacgucucugcaguuacacagcucacgagugccugcugggguggaaccuggucugucu

SEQ ID NO: 1009 - RNA, 67 nt, Homo sapiens
guggcacucaaacugugggggcacuuucugcucucuggugaaagugccgccaucuuuugaguguuac

SEQ ID NO: 1010 - RNA, 66 nt, Homo sapiens
gguaacacucaaaagauggcggcacuuucaccagagagcagaaagugcccccacaguuugagugcc

SEQ ID NO: 1011 - RNA, 67 nt, Homo sapiens
gugggccucaaauguggagcacuauucugauguccaaguggaaagugcugcgacauuugagcgucac

SEQ ID NO: 1012 - RNA, 69 nt, Homo sapiens
gggauacucaaaaugggggcgcuuuccuuuuugucuguacugggaagugcuucgauuuugggguguccc

SEQ ID NO: 1013 - RNA, 72 nt, Homo sapiens
uacaucggccauuauaauacaaccugauaaguguuauagcacuuaucagauuguauuguaauugucugugua

SEQ ID NO: 1014 - RNA, 72 nt, Homo sapiens
acucggauggauauaauacaaccugcuaaguguccuagcacuuagcagguuguauuaucauuguccgugucu

SEQ ID NO: 1015 - RNA, 70 nt, Homo sapiens
acacggacaaugauaauacaaccugcuaagugcuaggacacuuagcagguuguauuauauccauccgagu

SEQ ID NO: 1016 - RNA, 64 nt, Homo sapiens
ccccgcgacgagccccucgcacaaaccggaccugagcguuuuguucguucggcucgcgugaggc

SEQ ID NO: 1017 - RNA, 68 nt, Homo sapiens
uaaaagguagauucuccuucuaugaguacauuauuuaugauuaaucauagaggaaaauccacguuuuc

SEQ ID NO: 1018 - RNA, 80 nt, Homo sapiens
gguauuuaaaagguagauuuuccuucuaugguuacguguuugaugguuaaucauagaggaaaauccacguuuucaguauc

SEQ ID NO: 1019 - RNA, 100 nt, Homo sapiens
caguccuucuuugguauuuaaaacguggauauuccuucuauguuuacgugauuccugguuaaucauagaggaaaauccauguuuucaguaucaaaugcug

SEQ ID NO: 1020 - RNA, 66 nt, Homo sapiens
aaaagguggauauuccuucuauguuuauguuauuuaugguuaaacauagaggaaauuccacguuuu

SEQ ID NO: 1021 - RNA, 69 nt, Homo sapiens
uugagcagagguugcccuuggugaauucgcuuuauuuauguugaaucacacaaaggcaacuuuuguuug

SEQ ID NO: 1022 - RNA, 66 nt, Homo sapiens
agggcuccugacuccagguccuguguguuaccuagaaauagcacuggacuuggagucagaaggccu

SEQ ID NO: 1023 - RNA, 57 nt, Homo sapiens
ggucauugagucuucaaggcuaguggaaagagcacuggacuuggaggcagaaagacc

SEQ ID NO: 1024 - RNA, 81 nt, Homo sapiens
ggaggccaucacuggacuuggagucagaagaguggagucgggucagacuucaacucugacuuugaagguggugagugccuc

SEQ ID NO: 1025 - RNA, 54 nt, Homo sapiens
acuguuucuguccuuguucuuguuguuauuacuggacuuggagucagaaacagg

SEQ ID NO: 1026 - RNA, 98 nt, Homo sapiens
gaaugguuacaaggagagaacacuggacuuggagucagaaaacuuucauccaagucauucccugcucuaagucccauuucuguuccaugagauuguuu

SEQ ID NO: 1027 - RNA, 79 nt, Homo sapiens
cugacuccaguguccaggccaggggcagacaguggacagagaacagugcccaagaccacuggacuuggagucaggacau

SEQ ID NO: 1028 - RNA, 78 nt, Homo sapiens
gucagguccuggacucccauaguuuucaggcugcuaaacaacagaacgagcacuggacuuggagccagaagucuuggg

SEQ ID NO: 1029 - RNA, 41 nt, Homo sapiens
cacugggcuuggagucagaagaccuggcuccagcccagcuc

SEQ ID NO: 1030 - RNA, 83 nt, Homo sapiens
acaggaacacuggacuuggugucagaugggaugagcccuggcucuguuuccuagcagcaaucugaucuugagcuagucacugg

SEQ ID NO: 1031 - RNA, 76 nt, Homo sapiens
gggagcacuggacuaggagucagaagguggaguucugggugcuguuuucccacucuugggcccugggcauguucug

SEQ ID NO: 1032 - RNA, 67 nt, Homo sapiens
agagaugguagacuauggaacguaggcguuaugauuucugaccuauguaacaugguccacuaacucu

SEQ ID NO: 1033 - RNA, 61 nt, Homo sapiens
aagaugguugaccauagaacaugcgcuaucucugugucguauguaauaugguccacaucuu

SEQ ID NO: 1034 - RNA, 75 nt, Homo sapiens
uacuuaaagcgagguugcccuuuguauauucgguuuauugacauggaauauacaagggcaagcucucugugagua

SEQ ID NO: 1035 - RNA, 76 nt, Homo sapiens
uacuugaagagaaguuguucgugguggauucgcuuuacuuaugacgaaucauucacggacaacacuuuuuucagua

SEQ ID NO: 1036 - RNA, 73 nt, Homo sapiens
cuccucagaucagaaggugauuguggcuuuggguggauauuaaucagccacagcacugccuggucagaaagag

SEQ ID NO: 1037 - RNA, 88 nt, Homo sapiens
uguuaaaucaggaauuuuaaacaauuccuagacaauauguauaauguucauaagucauuccuagaaauuguucauaaugccuguaaca

SEQ ID NO: 1038 - RNA, 79 nt, Homo sapiens
ugguacucggggagagguuacccgagcaacuuugcaucuggacgacgaauguugcucggugaaccccuuuucgguauca

SEQ ID NO: 1039 - RNA, 80 nt, Homo sapiens
gguaccugagaagagguugucugugaugaguucgcuuuuauuaaugacgaauauaacacagauggccuguuuucaguacc

SEQ ID NO: 1040 - RNA, 96 nt, Homo sapiens
ugguacuuggagagauaguagaccguauagcguacgcuuuaucugugacguauguaacacgguccacuaacccucaguaucaaauccauccccgag

SEQ ID NO: 1041 - RNA, 91 nt, Homo sapiens
cugggguacggggauggauggucgaccaguuggaaaguaauuguuucuaauguacuucaccugguccacuagccguccguauccgcugcag

SEQ ID NO: 1042 - RNA, 85 nt, Homo sapiens
gcacauuguaggccucauuaaauguuuguugaaugaaaaaaugaaucaucaacagacauuaauugggcgccugcucugugaucuc

SEQ ID NO: 1043 - RNA, 90 nt, Homo sapiens
gagagaagcacuggacuuagggucagaaggccugagucucucugcugcagaugggcucucugucccugagccaagcuuuguccucccugg

SEQ ID NO: 1044 - RNA, 94 nt, Homo sapiens
auaaaggaaguuaggcugaggggcagagagcgagacuuuucuauuuuccaaaagcucggucugaggccccucagucuugcuuccuaacccgcgc

SEQ ID NO: 1045 - RNA, 98 nt, Homo sapiens
cgaggggauacagcagcaauucauguuuugaaguguucuaaaugguucaaaacgugaggcgcugcuauacccccucguggggaagguagaaggugggg

SEQ ID NO: 1046 - RNA, 87 nt, Homo sapiens
gaaagcgcuuuggaaugacacgaucacucccguugagugggcacccgagaagccaucgggaaugucguguccgcccagugcucuuuc

SEQ ID NO: 1047 - RNA, 83 nt, Homo sapiens
cgccggccgaugggcgucuuaccagacaugguuagaccuggcccucugucuaauacugucugguaaaaccguccauccgcugc

SEQ ID NO: 1048 - RNA, 114 nt, Homo sapiens
uccugcuuguccugcgaggugucuugcaggccgucaugcaggccacacugacgguaacguugcaggucgucuugcagggcuucucgcaagacgacauccucaucaccaacgacg

SEQ ID NO: 1049 - RNA, 94 nt, Homo sapiens
ugacuccuccaggucuuggaguaggucauuggguggauccucuauuuccuuacgugggccacuggauggcuccuccaugucuuggaguagauca

SEQ ID NO: 1050 - RNA, 93 nt, Homo sapiens
ccggggagaaguacggugagccugucauuauucagagaggcuagauccucuguguugagaaggaucaugaugggcuccucgguguucuccagg

SEQ ID NO: 1051 - RNA, 111 nt, Homo sapiens
gccgggagguugaacauccugcauagugcugccaggaaaucccuauuucauauaagagggggcuggcugguugcauauguaggaugucccaucucccagcccacuucguca

SEQ ID NO: 1052 - RNA, 91 nt, Homo sapiens
cugugugugaugagcuggcaguguauuguuagcugguugaauaugugaauggcaucggcuaacaugcaacugcugucuuauugcauauaca

SEQ ID NO: 1053 - RNA, 97 nt, Homo sapiens
ugaccugaaucagguaggcaguguauuguuagcuggcugcuugggucaagucagcagccacaacuacccugccacuugcuucuggauaaauucuucu

SEQ ID NO: 1054 - RNA, 92 nt, Homo sapiens
gcugggaugugucagguaggcaguguauugcuagcggcuguuaaugauuuuaacaguugcuaguugcacuccucucuguugcauucagaagc

SEQ ID NO: 1055 - RNA, 91 nt, Homo sapiens
aaacgauacuaaacuguuuuugcgauguguuccuaauaugcacuauaaauauauugggaacauuuugcauguauaguuuuguaucaauaua

SEQ ID NO: 1056 - RNA, 100 nt, Homo sapiens
ccaaagaaagaugcuaaacuauuuuugcgauguguuccuaauauguaauauaaauguauuggggacauuuugcauucauaguuuuguaucaauaauaugg

SEQ ID NO: 1057 - RNA, 78 nt, Homo sapiens
gcagaauuauuuuugcaauauguuccugaauauguaauauaaguguauugggaucauuuugcauccauaguuuuguau

SEQ ID NO: 1058 - RNA, 72 nt, Homo sapiens
cuugggaauggcaaggaaaccguuaccauuacugaguuuaguaaugguaaugguucucuugcuauacccaga

SEQ ID NO: 1059 - RNA, 68 nt, Homo sapiens
uggguauagcaagagaaccauuaccauuacuaaacucaguaaugguaacgguuuccuugccauuccca

SEQ ID NO: 1060 - RNA, 85 nt, Homo sapiens
gcuaagcacuuacaacuguuugcagaggaaacugagacuuuguaacuaugucucagucucaucugcaaagaaguaagugcuuugc

SEQ ID NO: 1061 - RNA, 115 nt, Homo sapiens
ucuguuuaucaccagauccuagaacccuaucaauauugucucugcuguguaaauaguucugaguagugcaauauugcuuauaggguuuugguguuuggaaagaacaaugggcagg

SEQ ID NO: 1062 - RNA, 96 nt, Homo sapiens
ucccuggcgugaggguaugugccuuuggacuacaucguggaagccagcaccaugcaguccaugggcauauacacuugccucaaggccuaugucauc

SEQ ID NO: 1063 - RNA, 84 nt, Homo sapiens
guguguguauauguguguugcauguguguauauguguguauauauguacacauacacauacacgcaacacacauauauacaugc

SEQ ID NO: 1064 - RNA, 76 nt, Homo sapiens
gagggggaagacgggaggaaagaagggagugguuccaucacgccuccucacuccucuccucccgucuucuccucuc

SEQ ID NO: 1065 - RNA, 79 nt, Homo sapiens
agccucgucaggcucaguccccucccgauaaaccccuaaauagggacuuucccggggggugacccuggcuuuuuuggcg

SEQ ID NO: 1066 - RNA, 73 nt, Homo sapiens
acuuggagagaggcuggccgugaugaauucgauucaucaaagcgagucauacacggcucuccucucuuuuagu

SEQ ID NO: 1067 - RNA, 68 nt, Homo sapiens
gcauccuguacugagcugccccgaggcccuucaugcugcccagcucggggcagcucaguacaggauac

SEQ ID NO: 1068 - RNA, 80 nt, Homo sapiens
gguacuugaagagugguuaucccugcuguguucgcuuaauuuaugacgaaucauacagggacauccaguuuuucaguauc

SEQ ID NO: 1069 - RNA, 84 nt, Homo sapiens
uugguacuuggagagugguuaucccuguccuguucguuuugcucaugucgaaucguacagggucauccacuuuuucaguaucaa

SEQ ID NO: 1070 - RNA, 83 nt, Homo sapiens
gagaaucaucucucccagauaauggcacucucaaacaaguuuccaaauuguuugaaaggcuauuucuuggucagaugacucuc

SEQ ID NO: 1071 - RNA, 84 nt, Homo sapiens
guggcagcuugguggucguaugugugacgccauuuacuugaaccuuuaggagugacaucacauauacggcagcuaaacugcuac

SEQ ID NO: 1072 - RNA, 128 nt, Homo sapiens
uggaggccuugcugguuuggaaaguucauuguucgacaccauggaucuccaggugggucaaguuuagagaugcaccaaccuggaggacuccaugcuguugagcuguucacaagcagcggacacuucca

SEQ ID NO: 1073 - RNA, 84 nt, Homo sapiens
uugacuuagcuggguaguggggaacccuuccaugaggaguagaacacuccuuaugcaagauucccuucuaccuggcuggguugg

SEQ ID NO: 1074 - RNA, 116 nt, Homo sapiens
caacuacagccacuacuacaggaccaucgaggaccugcgggacaagauucuuggugccaccauugagaacgccaggauuguccugcagaucaacaaugcucaacuggcugcagaug

SEQ ID NO: 1075 - RNA, 89 nt, Homo sapiens
cuggccuccagggcuuuguacaugguaggcuuucauucauucguuugcacauucggugaaggucuacugugugccaggcccugugccag

SEQ ID NO: 1076 - RNA, 81 nt, Homo sapiens
gauacucgaaggagagguuguccguguugucuucucuuuauuuaugaugaaacauacacgggaaaccucuuuuuuaguauc

SEQ ID NO: 1077 - RNA, 82 nt, Homo sapiens
ugguaccugaaaagaaguugcccauguuauuuucgcuuuauaugugacgaaacaaacauggugcacuucuuuuucgguauca

SEQ ID NO: 1078 - RNA, 102 nt, Homo sapiens
cccaagucagguacucgaauggagguuguccaugguguguucauuuuauuuaugaugaguauuacauggccaaucuccuuucgguacucaauucuucuuggg

SEQ ID NO: 1079 - RNA, 112 nt, Homo sapiens
ccaccccgguccugcucccgccccagcagcacacugugguuuguacggcacuguggccacguccaaaccacacugugguguuagagcgagggugggggaggcaccgccgagg

SEQ ID NO: 1080 - RNA, 124 nt, Homo sapiens
aacccuccuugggaagugaagcucaggcugugauuucaagccagggggcguuuuucuauaacuggaugaaaagcaccuccagagcuugaagcucacaguuugagagcaaucgucuaaggaaguu

SEQ ID NO: 1081 - RNA, 122 nt, Homo sapiens
gcccuguccccugugccuugggcgggcggcuguuaagacuugcagugauguuuaacuccucuccacgugaacaucacagcaagucugugcugcuucccgucccuacgcugccugggcagggu

SEQ ID NO: 1082 - RNA, 73 nt, Homo sapiens
ggaagcagcacagacuugcugugauguucacguggagaggaguuaaacaucacugcaagucuuaacagccgcc

SEQ ID NO: 1083 - RNA, 84 nt, Homo sapiens
gcucccccucucuaauccuugcuaccugggugagagugcugucugaaugcaaugcaccugggcaaggauucugagagcgagagc

SEQ ID NO: 1084 - RNA, 79 nt, Homo sapiens
cccccucucuaauccuugcuaccugggugagagugcuuucugaaugcagugcacccaggcaaggauucugcaaggggga

SEQ ID NO: 1085 - RNA, 84 nt, Homo sapiens
gcucuuccucucuaauccuuugucccugggugagagugcuuucugaaugcaaugcacccgggcaaggauucugagagggugagc

SEQ ID NO: 1086 - RNA, 86 nt, Homo sapiens
ugcucccccucucuaauccuugcuaucugggugcuagugcuggcucaaugcaaugcaccugggcaaggauucagagagggggagcu

SEQ ID NO: 1087 - RNA, 71 nt, Homo sapiens
ugcccuagcagcgggaacaguucugcagugagcgaucggugcucugggguauuguuuccgcugccagggua

SEQ ID NO: 1088 - RNA, 83 nt, Homo sapiens
gcugcuguugggagacccuggucugcacucuaucuguauucuuacugaagggagugcagggcaggguuucccauacagagggc

SEQ ID NO: 1089 - RNA, 84 nt, Homo sapiens
gaugcacccagugggggagccaggaaguauugauguuucugccaguuuagcgucaacacuugcugguuuccucucuggagcauc

SEQ ID NO: 1090 - RNA, 124 nt, Homo sapiens
gccaccaccaucagccauacuauguguagugccuuauucaggaagguguuacuuaauagauuaauauuuguaaggcacccuucugaguagaguaaugugcaacauggacaacauuugugguggc

SEQ ID NO: 1091 - RNA, 94 nt, Homo sapiens
gugcuguguguagugcuucacuucaagaagugccaugcaugugucuagaaauauguuuugcaccuuuuggagugaaauaaugcacaacagauac

SEQ ID NO: 1092 - RNA, 115 nt, Homo sapiens
ccaccuucagcugaguguagugcccuacuccagagggcgucacucauguaaacuaaaacaugauuguagccuuuuggaguagaguaauacacaucacguaacgcauauuuggugg

SEQ ID NO: 1093 - RNA, 94 nt, Homo sapiens
caugcugugugugguacccuacugcagacaguggcaaucauguauaauuaaaaaugauugguacgucuguggguagaguacugcaugacacaug

SEQ ID NO: 1094 - RNA, 91 nt, Homo sapiens
caugcugugugugguacccuacugcagacaguggcaaucauguauaauuaaaaaugauugguacgucuguggguagaguacugcaugacac

SEQ ID NO: 1095 - RNA, 75 nt, Homo sapiens
gugguacccuacugcagacguggcaaucauguauaauuaaaaaugauugguacgucuguggguagaguacugcau

SEQ ID NO: 1096 - RNA, 74 nt, Homo sapiens
gugguguccuacucaggagaguggcaaucacauguaauuaggugugauugaaaccucuaagaguggaguaacac

SEQ ID NO: 1097 - RNA, 87 nt, Homo sapiens
caauagacacccaucgugucuuuugcucugcagucaguaaauauuuuuuugugaauguguagcaaaagacagaauggugguccauug

SEQ ID NO: 1098 - RNA, 87 nt, Homo sapiens; identical to SEQ ID NO: 1097

SEQ ID NO: 1099 - RNA, 84 nt, Homo sapiens
ucucagucuguggcacucagccuugagggcacuuucuggugccagaaugaaagugcugucauagcugagguccaaugacugagg

SEQ ID NO: 1100 - RNA, 98 nt, Homo sapiens
gguacuucucagucuguggcacucagccuugagggcacuuucuggugccagaaugaaagugcugucauagcugagguccaaugacugaggcgagcacc

SEQ ID NO: 1101 - RNA, 129 nt, Homo sapiens
gggaugccacauucagccauucagcguacagugccuuucacagggaggugucauuuaugugaacuaaaauauaaauuucaccuuucugagaaggguaauguacagcaugcacugcauaugugguguccc

SEQ ID NO: 1102 - RNA, 127 nt, Homo sapiens
ggaugccacauucagccauucagugugcagugccuuucacagggaggugucauuuaugugaacuaaaauauaaauuucaccuuucugagaaggguaauguacagcaugcacugcauauguggugucc

SEQ ID NO: 1103 - RNA, 84 nt, Homo sapiens
guguacagugccuuucacaaggaggugucauuuaugugaacuaaaauauaaaugucaccuuuuugagaggaguaauguacagca

SEQ ID NO: 1104 - RNA, 84 nt, Homo sapiens
gcguacagugccuuucucaaggaggugucguuuaugugaacuaaaauauaaauuucaccuuucugagaagaguaauguacagca

SEQ ID NO: 1105 - RNA, 98 nt, Homo sapiens
aacauguugucugugguacccuacucuggagagugacaaucauguauaauuaaauuugauugacacuucugugaguagaguaacgcaugacacguacg

SEQ ID NO: 1106 - RNA, 88 nt, Homo sapiens
guugucugugguacccuacucuggagagugacaaucauguauaacuaaauuugauugacacuucugugaguagaguaacgcaugacac

SEQ ID NO: 1107 - RNA, 88 nt, Homo sapiens; identical to SEQ ID NO: 1106

SEQ ID NO: 1108 - RNA, 80 nt, Homo sapiens
caugugguacucuucucaagagggaggcaaucauguguaauuagauaugauugacaccucugugaguggaguaacacaug

SEQ ID NO: 1109 - RNA, 83 nt, Homo sapiens
ucucaugcagucauucuccaaaagaaagcacuuucuguugucugaaagcagagugccuucuuuuggagcguuacuguuugaga

SEQ ID NO: 1110 - RNA, 83 nt, Homo sapiens; identical to SEQ ID NO: 1109

SEQ ID NO: 1111 - RNA, 90 nt, Homo sapiens
ucucaggcugugaccuucucgaggaaagaagcacuuucuguugucugaaagaaaagaaagugcuuccuuucagaggguuacgguuugaga

SEQ ID NO: 1112 - RNA, 90 nt, Homo sapiens
ucucagguugugaccuucucgaggaaagaagcacuuucuguugucugaaagaaaagaaagugcuuccuuucagaggguuacgguuugaga

SEQ ID NO: 1113 - RNA, 90 nt, Homo sapiens
ucucaggcugugaccaucuggagguaagaagcacuuucuguuuugugaaagaaaagaaagugcuuccuuucagaggguuacucuuugaga

SEQ ID NO: 1114 - RNA, 85 nt, Homo sapiens
ucucaugaugugaccaucuggagguaagaagcacuuuguguuuugugaaagaaagugcuuccuuucagaggguuacucuuugaga

SEQ ID NO: 1115 - RNA, 87 nt, Homo sapiens
ucucaggcagugacccucuagauggaagcacugucuguuguauaaaagaaaagaucgugcaucccuuuagaguguuacuguuugaga

SEQ ID NO: 1116 - RNA, 67 nt, Homo sapiens
gugacccucuagauggaagcacugucuguugucuaagaaaagaucgugcaucccuuuagaguguuac

SEQ ID NO: 1117 - RNA, 95 nt, Homo sapiens
gaagaucucaggcagugacccucuagauggaagcacugucuguugucuaagaaaagaucgugcauccuuuuagaguguuacuguuugagaaaauc

SEQ ID NO: 1118 - RNA, 85 nt, Homo sapiens
ucucaagcugugacugcaaagggaagcccuuucuguugucugaaagaagagaaagcgcuucccuuugcuggauuacgguuugaga

SEQ ID NO: 1119 - RNA, 87 nt, Homo sapiens
ucucaagcugugggucugcaaagggaagcccuuucuguugucuaaaagaagagaaagcgcuucccuuugcuggauuacgguuugaga

SEQ ID NO: 1120 - RNA, 83 nt, Homo sapiens
ucaugcuguggcccuccagagggaagcgcuuucuguugucugaaagaaaacaaagcgcuccccuuuagagguuuacgguuuga

SEQ ID NO: 1121 - RNA, 101 nt, Homo sapiens
gcgagaagaucucaugcugugacucucuggagggaagcacuuucuguugucugaaagaaaacaaagcgcuucucuuuagaguguuacgguuugagaaaagc

SEQ ID NO: 1122 - RNA, 87 nt, Homo sapiens
ucccaugcugugacccucuagagggaagcacuuucuguugucugaaagaaaccaaagcgcuucccuuuggagcguuacgguuugaga

SEQ ID NO: 1123 - RNA, 88 nt, Homo sapiens
ucucaggcugugacccucuagagggaagcgcuuucuguuggcuaaaagaaaagaaagcgcuucccuucagaguguuaacgcuuugaga

SEQ ID NO: 1124 - RNA, 87 nt, Homo sapiens
ucucaugcugugacccucuagagggaagcacuuucucuugucuaaaagaaaagaaagcgcuucucuuuagaggauuacucuuugaga

SEQ ID NO: 1125 - RNA, 85 nt, Homo sapiens
cucaggcugugacacucuagagggaagcgcuuucuguugucugaaagaaaggaaagugcauccuuuuagaguguuacuguuugag

SEQ ID NO: 1126 - RNA, 87 nt, Homo sapiens
ucucaggcugugucccucuacagggaagcgcuuucuguugucugaaagaaaggaaagugcauccuuuuagaguguuacuguuugaga

SEQ ID NO: 1127 - RNA, 81 nt, Homo sapiens
caugcugugacccucuagagggaagcgcuuucuguugucugaaagaaaagaaagugcauccuuuuagagguuuacuguuug

SEQ ID NO: 1128 - RNA, 87 nt, Homo sapiens
ucucagccugugacccucuagagggaagcgcuuucuguugucugaaagaaaagaaagugcaucuuuuuagaggauuacaguuugaga

SEQ ID NO: 1129 - RNA, 88 nt, Homo sapiens
ucccaugcugugacccuccaaagggaagcgcuuucuguuuguuuucucuuaaacaaagugccucccuuuagaguguuaccguuuggga

SEQ ID NO: 1130 - RNA, 84 nt, Homo sapiens
ucucaugcagucauucuccaaaagggagcacuuucuguuugaaagaaaacaaagugccuccuuuuagaguguuacuguuugaga

SEQ ID NO: 1131 - RNA, 85 nt, Homo sapiens
cucaggcugugacccuccagagggaaguacuuucuguugucugagagaaaagaaagugcuucccuuuggacuguuucgguuugag

SEQ ID NO: 1132 - RNA, 61 nt, Homo sapiens
cccucuacagggaagcgcuuucuguugucugaaagaaaagaaagugcuuccuuuuagaggg

SEQ ID NO: 1133 - RNA, 87 nt, Homo sapiens
ucucaggcugucguccucuagagggaagcacuuucuguugucugaaagaaaagaaagugcuuccuuuuagaggguuaccguuugaga

SEQ ID NO: 1134 - RNA, 87 nt, Homo sapiens
ucucaagcugugagucuacaaagggaagcccuuucuguugucuaaaagaaaagaaagugcuucucuuugguggguuacgguuugaga

SEQ ID NO: 1135 - RNA, 87 nt, Homo sapiens
ucuccugcugugacccucaagauggaagcaguuucuguugucugaaaggaaagaaagugcuuccuuuuugaggguuacuguuugaga

SEQ ID NO: 1136 - RNA, 87 nt, Homo sapiens
ucucaggcugugacccucuaaagggaagcgcuuucuguggucagaaagaaaagcaagugcuuccuuuuagaggguuaccguuuggga

SEQ ID NO: 1137 - RNA, 90 nt, Homo sapiens
ucccaugcugugacccucuagaggaagcacuuucuguuuguugucugagaaaaaacaaagugcuucccuuuagaguguuaccguuuggga

SEQ ID NO: 1138 - RNA, 88 nt, Homo sapiens
ucccaugcugugacccucuagaggaagcacuuucuguuuguugucugagaaaaaacaaagugcuucccuuuagaguuacuguuuggga

SEQ ID NO: 1139 - RNA, 87 nt, Homo sapiens
ucucaggcugugacccuccaaagggaagaacuuucuguugucuaaaagaaaagaacgcacuucccuuuagaguguuaccgugugaga

SEQ ID NO: 1140 - RNA, 87 nt, Homo sapiens
ucucgggcugugacucuccaaagggaagaauuuucucuugucuaaaagaaaagaacgcacuucccuuuagaguguuaccgugugaga

SEQ ID NO: 1141 - RNA, 87 nt, Homo sapiens
ucucaggcugugucccucuagagggaagcgcuuucuguugucugaaagaaaagaaaaugguucccuuuagaguguuacgcuuugaga

SEQ ID NO: 1142 - RNA, 87 nt, Homo sapiens
ucucaugcugugacccucuagagggaagcgcuuucuguugucugaaagaaaagaacgcgcuucccuauagaggguuacccuuugaga

SEQ ID NO: 1143 - RNA, 87 nt, Homo sapiens
ucucaugcugugacccuacaaagggaagcacuuucucuuguccaaaggaaaagaaggcgcuucccuuuggaguguuacgguuugaga

SEQ ID NO: 1144 - RNA, 85 nt, Homo sapiens
cucaagcugugacucuccagagggaugcacuuucucuuaugugaaaaaaaagaaggcgcuucccuuuagagcguuacgguuuggg

SEQ ID NO: 1145 - RNA, 85 nt, Homo sapiens
cucaggcugugacccucuagagggaagcacuuucuguugcuugaaagaagagaaagcgcuuccuuuuagaggauuacucuuugag

SEQ ID NO: 1146 - RNA, 65 nt, Homo sapiens
gugacccucuagagggaagcacuuucuguugaaagaaaagaacaugcauccuuucagaggguuac

SEQ ID NO: 1147 - RNA, 83 nt, Homo sapiens
ucaggcugugacccucuugagggaagcacuuucuguugucugaaagaagagaaagugcuuccuuuuagaggcuuacugucuga

SEQ ID NO: 1148 - RNA, 85 nt, Homo sapiens
ucucaagcugugacugcaaagggaagcccuuucuguugucuaaaagaaaagaaagugcuucccuuuggugaauuacgguuugaga

SEQ ID NO: 1149 - RNA, 91 nt, Homo sapiens
cgacuugcuuucucuccuccaugccuugaguguaggaccguuggcaucuuaauuacccucccacacccaaggcuugcaaaaaagcgagccu

SEQ ID NO: 1150 - RNA, 78 nt, Homo sapiens
auacuugaggagaaauuauccuugguguguucgcuuuauuuaugaugaaucauacaaggacaauuucuuuuugaguau

SEQ ID NO: 1151 - RNA, 84 nt, Homo sapiens
acgucagggaaaggauucugcugucggucccacuccaaaguucacagaauggguggugggcacagaaucuggacucugcuugug

SEQ ID NO: 1152 - RNA, 97 nt, Homo sapiens
cagaucucagacaucucggggaucaucaugucacgagauaccagugugcacuugugacagauugauaacugaaaggucugggagccacucaucuuca

SEQ ID NO: 1153 - RNA, 78 nt, Homo sapiens
uacuuaaugagaaguugcccguguuuuuuucgcuuuauuugugacgaaacauucgcggugcacuucuuuuucaguauc

SEQ ID NO: 1154 - RNA, 91 nt, Homo sapiens
auuuucaucaccuagggaucuuguuaaaaagcagauucugauucagggaccaagauucugcauuuuuagcaaguucucaagugaugcuaau

SEQ ID NO: 1155 - RNA, 78 nt, Homo sapiens
ggaauuuuguuaaaaugcagaauccauuucuguagcucugagacuagaccugagguugugcauuucuaacaaagugcc

SEQ ID NO: 1156 - RNA, 106 nt, Homo sapiens
cccagccuggcacauuaguaggccucaguaaauguuuauuagaugaauaaaugaaugacucaucagcaaacauuuauugugugccugcuaaagugagcuccacagg

SEQ ID NO: 1157 - RNA, 97 nt, Homo sapiens
ugcagggagguauuaaguuggugcaaaaguaauugugauuuuugccauuaaaaguaacgacaaaacuggcaauuacuuuugcaccaaaccugguauu

SEQ ID NO: 1158 - RNA, 97 nt, Homo sapiens
ugugauguguauuagguuugugcaaaaguaauugggguuuuuugccguuaaaaguaauggcaaaacuggcaauuacuuuugcaccaaacuaauauaa

SEQ ID NO: 1159 - RNA, 97 nt, Homo sapiens
ccuagaauguuauuaggucggugcaaaaguaauugcgaguuuuaccauuacuuucaauggcaaaacuggcaauuacuuuugcaccaacguaauacuu

SEQ ID NO: 1160 - RNA, 97 nt, Homo sapiens
cuuuauuagucuggugcaaaagaaacugugguuuuugccauuacuuuuacaggcaaaaaccacaauuacuuuugcaccaaccuaauauaacuuguuu

SEQ ID NO: 1161 - RNA, 97 nt, Homo sapiens
uuuuauuagguuggugcaaaagaaacugugguuuuugccauuacuuucaauggcaaaaaccacaauuacuuuugcaccaaccuaaaucuucccucuc

SEQ ID NO: 1162 - RNA, 84 nt, Homo sapiens
auguuggugcaaaaguaauuguggauuuugcuauuacuuguauuuauuuguaaugcaaaacccgcaauuaguuuugcaccaacc

SEQ ID NO: 1163 - RNA, 88 nt, Homo sapiens
guauuagguuggugcaaaaguuauugugguuuuugcuauuuuuuuuuaauggcaaaaaccggcaauuacuuuugcacuaaccuaguag

SEQ ID NO: 1164 - RNA, 82 nt, Homo sapiens
cuguuagguuggugcaaaaguaauugugguuuuugaaaguaacuuggcgaaaacgacaaugacuuuugcaccaaucuaauac

SEQ ID NO: 1165 - RNA, 70 nt, Homo sapiens
gcaguuuuugccauuaaguugcgguuuuugccauuauaauggcaaaaacugcaauuacuuucacaccugc

SEQ ID NO: 1166 - RNA, 67 nt, Homo sapiens
ugugcaaaaguaauugugguuuuugucauuuaaaaguaauggcaaaaacugcaauuacuuucacacc

SEQ ID NO: 1167 - RNA, 66 nt, Homo sapiens
gugcaaagguaauugugguuucugcuuuuaaagguaauggcaaauauuacauuuacuuuugcacca

SEQ ID NO: 1168 - RNA, 64 nt, Homo sapiens
ugcaaagguaauugugguuucugccauugaaaguaaaggcaagaaccucaauuaccuuugcagc

SEQ ID NO: 1169 - RNA, 76 nt, Homo sapiens
agguuggugcaaaagugauugcaguguuugccaauaaaaguaaugacaaaaacugcaguuacuuuugcaccagccc

SEQ ID NO: 1170 - RNA, 88 nt, Homo sapiens
guauuagguuggugcaaagguaauugcaguuuuucccauuuaaaauauggaaaaaaaaaucacaauuacuuuugcaucaaccuaauaa

SEQ ID NO: 1171 - RNA, 72 nt, Homo sapiens
auugguguaaaaguaauugcagguuaugccauuaaaaguaaugguaaaaacugcaauuacuuuuacacuaac

SEQ ID NO: 1172 - RNA, 92 nt, Homo sapiens
aagguauuagguuggugcaaaaguaauugcaguuuuugcuauuacuuuuaaugguaaaaacugcaauuacuuuuacaccaaccuaauauuua

SEQ ID NO: 1173 - RNA, 57 nt, Homo sapiens
gugcaaaaguaacugcgguuuuugagaaguaauugaaaaccgcaauuacuuuugcag

SEQ ID NO: 1174 - RNA, 97 nt, Homo sapiens
ggucggugcaaaaguaauugcuguuuuugccauuaaaaauaauggcauuaaaaguaauggcaaaaacggcaaugacuuuuguaccaaucuaauaucu

SEQ ID NO: 1175 - RNA, 74 nt, Homo sapiens
aguuggugcaaaaguaauugcgguuuuugccgucgaaaauaauggcaaaaacugcaguuacuuuuguaccaaug

SEQ ID NO: 1176 - RNA, 83 nt, Homo sapiens
cauuagguuggugcaaaaggcauugugguuuuugccuauaaaaguaauggcaaaaaccgcaauuccuuuugcaccaaccuaau

SEQ ID NO: 1177 - RNA, 96 nt, Homo sapiens
aacuauucuuagguugaugcagaaguaacuacgguuuuugcaguugaaaguaauggcaaagaccgugacuacuuuugcaacagccuaauaguuucu

SEQ ID NO: 1178 - RNA, 96 nt, Homo sapiens
accaauuccuagguuggugcaaaaguaauugcggucuuugucauuaaaaccaauaacaaaaaccacaauuacuuuuuacugaccuaaagauuaauu

SEQ ID NO: 1179 - RNA, 58 nt, Homo sapiens
gaaaguaauugcuguuuuugccauuacuuucaguggcaaaaacugcaauuacuuuugc

SEQ ID NO: 1180 - RNA, 57 nt, Homo sapiens
aaaaguaauugcaguuuuugcuguugaacguagugguaaaacugcaguuauuuuugc

SEQ ID NO: 1181 - RNA, 58 nt, Homo sapiens
aaaaguaauugcggguuuugccguugcuuuuaaugguaaaacccacaauuauguuugu

SEQ ID NO: 1182 - RNA, 58 nt, Homo sapiens
aaaaguuauugcgguuuuggcugccaaaagaaauggccaaaaccgcaguaacuuuugu

SEQ ID NO: 1183 - RNA, 54 nt, Homo sapiens
aaaaguaauugcgguuuuugcuauugguuuuaauggcaguuacuuuugcaccag

SEQ ID NO: 1184 - RNA, 62 nt, Homo sapiens
aaaaguacuugcggauuugccaucaccuuuaccuuuaauggcaaaacugcaguuacuuuugc

SEQ ID NO: 1185 - RNA, 65 nt, Homo sapiens
uaggucggugcaaaagucaucacgguuuuuaccauuaaaaccgcgaugacuuuugcaucaaccua

SEQ ID NO: 1186 - RNA, 73 nt, Homo sapiens
gauuggugcagaaguaauugcgguuuugccauggaaaguaauggcaaaaaccguaauuacuuuuguaccaacc

SEQ ID NO: 1187 - RNA, 97 nt, Homo sapiens
cagacuauauauuuagguuggcgcaaaaguaauugugguuuuggccuuuauuuucaauggcaagaaccucaguugcuuuugugccaaccuaauacuu

SEQ ID NO: 1188 - RNA, 97 nt, Homo sapiens
cauuggcaucuauuagguuggugcaaaaguaauugcgguuuuugccauuacuuucaguagcaaaaaucucaauuacuuuugcaccaacuuaauacuu

SEQ ID NO: 1189 - RNA, 97 nt, Homo sapiens
aaacaaguuauauuagguuggugcaaaaguaauugugguuuuugccuguaaaaguaauggcaaaaaccacaguuucuuuugcaccagacuaauaaag

SEQ ID NO: 1190 - RNA, 97 nt, Homo sapiens
gagagggaagauuuagguuggugcaaaaguaauugugguuuuugccauugaaaguaauggcaaaaaccacaguuucuuuugcaccaaccuaauaaaa

SEQ ID NO: 1191 - RNA, 88 nt, Homo sapiens
uuauuagguugguacaaaagcaaucgcgguuuuugcuauuacuuuuaaaggcaaaaacugagacuacuuuugcaccaaccugauagaa

SEQ ID NO: 1192 - RNA, 84 nt, Homo sapiens
auuagguuggugcaaaaguaaucacaguuuuugacauuacuuucaaagacaaaaacuguaauuacuuuuggaccaaccuaauag

SEQ ID NO: 1193 - RNA, 98 nt, Homo sapiens
uaauaacuauuagguuggugcgaacauaauugcaguuuuuaucauuacuuuuaauggcaaaaacuguaauuacuuuugcaccaaccuaauauuuuagu

SEQ ID NO: 1194 - RNA, 87 nt, Homo sapiens
auuagguuggugcaaaccuaauugcaauuuuugcaguuuuuuuaaguaauugcaaaaacuguaauuacuuuugcaccaaccuaauac

SEQ ID NO: 1195 - RNA, 105 nt, Homo sapiens
gaguucuaacguauuagguuggugcaaaaguaauagugguuuuugccauuaaaaguaaugacaaaaacuguaauuacuuuuggaacaauauuaauagaauuucag

SEQ ID NO: 1196 - RNA, 86 nt, Homo sapiens
uauuagguugcugcaaaaguaaucauguuuuuuuccauuguaaguaaugggaaaaacuguaauuacuuuuguaccaaccuaauagc

SEQ ID NO: 1197 - RNA, 89 nt, Homo sapiens
aguuauuagauuagugcaaaaguaauugcaguuuuugcauuacguucuauggcaaaacuguaauuacuuuuguaccaacauaauacuuc

SEQ ID NO: 1198 - RNA, 102 nt, Homo sapiens
ucuguccauuaggugggugcaaaaguaaucgcgguuuuugucauuacuuuuaaugguaaaaacuggaauuacuuuugcacugaccuaauauuaagccagaua

SEQ ID NO: 1199 - RNA, 88 nt, Homo sapiens
guauuagguuggugcaaaaguaaucgcgguuuuugucauuacuuucaauggcaaacaccacaauuacuuuugcaccaaccuaauauaa

SEQ ID NO: 1200 - RNA, 118 nt, Homo sapiens
ucugauucugcauguauuagguuggugcaaaaguaaucgcgguuuuugucauugaaaguaauagcaaaaacugcaauuacuuuugcaccaaccuaaaaguagucacugucuucagaua

SEQ ID NO: 1201 - RNA, 111 nt, Homo sapiens
gcuauuagguuggugcaaaaguaaucgcgguuuuugucauuacuuuaauuacuuuacguuucauuaaugacaaaaaccgcaauuacuuuugcaccaaccuaauacuugcua

SEQ ID NO: 1202 - RNA, 60 nt, Homo sapiens
acaaaaguaaucgcgguuuuugucauuacuuuuaacuguaaaaaccacgguugcuuuugc

SEQ ID NO: 1203 - RNA, 149 nt, Homo sapiens
cagauggcucugaaguuugcacccuauuagguuggugcaaaaguaauugcggauuuugccauuaaaaguaauggcaaaaauagcaauuauuuuuguaccagccuaguaucuuuucuccuucuaccaaacuuugucccugagccaucuca

SEQ ID NO: 1204 - RNA, 149 nt, Homo sapiens
uagauggcuccgaaguuugcauccuauuaguuuggugcaaaaguaauugcggauuuugccauuaaaaguaauggcaaaaauagcaauuauuuuuguaccagccuaguaucuuuucuccuucuaacaaaguucgucccugauccaucuca

SEQ ID NO: 1205 - RNA, 149 nt, Homo sapiens
cagauggcuccgaaguuuacauccuauuagguuugugcaaaaguaauugcggauuuugccauuaaaaguaauggcaaaaauagcaauuauuuuuguaccagccuaguaucuuuucuccuucuaccaaacuuugucccugagccaucuca

SEQ ID NO: 1206 - RNA, 77 nt, Homo sapiens
agguuggugcaaaaguaauugcggauuuugccauacuuuuaacggcaaaaaccacaaauauuauugcaccaaccuau

SEQ ID NO: 1207 - RNA, 112 nt, Homo sapiens
gggcagccagugaauaguuagcuggugcaaaaguaauugcggucuuugguauuacuuucaguggcaaaaacugcauuacuuuugcaccagccuacuagaacgcugaguucag

SEQ ID NO: 1208 - RNA, 116 nt, Homo sapiens
cuuuucucaaguauugcuguuagguuggugcaaaaguacuugcggauuuugcuuuacuuuuaauggcaaaaaccgcaauuauuuuugcuucaaccuaauaugaugcaaaauuggcu

SEQ ID NO: 1209 - RNA, 86 nt, Homo sapiens
uauuagguuggugcaaaaguauuugcggguuuugucguagaaaguaauggcaaaaacugcaguuacuugugcaccaaccaaaugcu

SEQ ID NO: 1210 - RNA, 86 nt, Homo sapiens
auauuagguuggugcaaagguauuugugguuuuugucauuaaaguaaugcaaaagccacaaauaccuuugcaccaaccuaauauua

SEQ ID NO: 1211 - RNA, 75 nt, Homo sapiens
agguuggugcaaaaguaauuguggauuuugucguuaaaaauagcaaaacccgcaauuacuuuugcaccaaccuaa

SEQ ID NO: 1212 - RNA, 114 nt, Homo sapiens
uggugaaaauguguugauuguaaugguuccuauucugaucaauaaacaugguuugagccuaguuacaaugaucuaaaauucacgguccaaaacugcaguuacuuuugcaccaac

SEQ ID NO: 1213 - RNA, 70 nt, Homo sapiens
uggugcaaaaguaauugcgguuuuugccauuaaaaguaaugcggccaaaacugcaguuacuuuugcaccc

SEQ ID NO: 1214 - RNA, 84 nt, Homo sapiens
auuagguugguauaaaauuaauugcaguuuuugucauuacuuucaauagcaaaaacugcaguuacuuuugcaccaauguaauac

SEQ ID NO: 1215 - RNA, 100 nt, Homo sapiens
auauuaggcuggugcaaaaguaauggcgguuuuugccauuacuuuucauuuuuaccauuaaaaguaauggcaaaaagcaugauuacuuuuucaccaaccu

SEQ ID NO: 1216 - RNA, 82 nt, Homo sapiens
uugcugcaaaaauaauugcaguuuuugccauuauuuuuaauaauuauaauaauggccaaaacugcaguuauuuuugcaccaa

SEQ ID NO: 1217 - RNA, 74 nt, Homo sapiens
aggguggugcaaaagugaucgugguuuuugcaauuuuuuaaugacaaaaaccacaauuacuuuugcaccaaccu

SEQ ID NO: 1218 - RNA, 81 nt, Homo sapiens
auuaggauggugcaaaaguaaugugguuuuuuucuuuacuuuuaauggcaaagacugcaauuacuuuugcgccaaccuaau

SEQ ID NO: 1219 - RNA, 80 nt, Homo sapiens
aauacuagguuugagcaaaaguaauugcgguuuugccaucaugccaaaagcuacaguuacuuuugcaccagccuaauauu

SEQ ID NO: 1220 - RNA, 74 nt, Homo sapiens
gguuggugcaaaaguaacugcgguuuuugccuuucaacauaauggcaaaacccacaauuacuuuugcaccaauc

SEQ ID NO: 1221 - RNA, 75 nt, Homo sapiens
agguuagugcaaaaguaauugcaguuuuugcguuacuuucaaucguaaaaacugcaauuacuuucacaccaaucu

SEQ ID NO: 1222 - RNA, 100 nt, Homo sapiens
augccaaauauuagguuggcacaaaaguaauuguggcuuuugccauuaaaaguaaugguaaaaacugcaauuacuuucgugccaaccuaauauuugugug

SEQ ID NO: 1223 - RNA, 110 nt, Homo sapiens
gccuaaacuauuagguuggugcaaaaguaaucacuguuuuugccauuacucucaguggcaaaaaccgugauuacuuuugcaccaaccuaguaacaccuucacuguggggg

SEQ ID NO: 1224 - RNA, 97 nt, Homo sapiens
aaguauuaaguuggugcaaaaguaauugagauuuuugcuacugaaaguaauggcaaaaaccgcaauuacuuuugcaccaaccuaauagaugccaaug

SEQ ID NO: 1225 - RNA, 96 nt, Homo sapiens
agacaugcaacucaagaauauauugagagcucauccauaguugucacugucucaaaucagugacaacuauggaugagcucuuaauauaucccaggc

SEQ ID NO: 1226 - RNA, 97 nt, Homo sapiens
ugaugcuuugcuggcuggugcagugccugagggaguaagagcccuguuguuguaagauagugucuuacucccucaggcacaucuccaacaagucucu

SEQ ID NO: 1227 - RNA, 97 nt, Homo sapiens
ugaugcuuugcuggcuggugcagugccugagggaguaagagcccuguuguugucagauagugucuuacucccucaggcacaucuccagcgagucucu

SEQ ID NO: 1228 - RNA, 95 nt, Homo sapiens
gaugcuuugcuggcuggugcagugccugagggaguaagaguccuguuguuguaagauagugucuuacucccucaggcacaucuccaacaagucuc

SEQ ID NO: 1229 - RNA, 97 nt, Homo sapiens
agagacuuguuggagaugugccugagggaguaagacacuaucuuacaacaacagggcucuuacucccucaggcacugcaccagccagcaaagcauca

SEQ ID NO: 1230 - RNA, 97 nt, Homo sapiens
agagacucgcuggagaugugccugagggaguaagacacuaucugacaacaacagggcucuuacucccucaggcacugcaccagccagcaaagcauca

SEQ ID NO: 1231 - RNA, 96 nt, Homo sapiens
ggggacugccgggugacccuggaaauccagaguggguggggccagucugaccguuucuaggcgacccacucuugguuuccaggguugcccuggaaa

SEQ ID NO: 1232 - RNA, 96 nt, Homo sapiens
agaugugcucuccuggcccaugaaaucaagcgugggugagaccuggugcagaacgggaaggcgacccauacuugguuucagaggcugugagaauaa

SEQ ID NO: 1233 - RNA, 96 nt, Homo sapiens
aaccauucaaauauaccacaguuuguuuaaccuuuugccuguugguugaagaugccuuucaacaggugacugguuagacaaacugugguauauaca

SEQ ID NO: 1234 - RNA, 68 nt, Homo sapiens
cuucaauuuuauuuuaaaacggugagauuuuguuuugucugagaaaaucucgcuguuuuagacugagg

SEQ ID NO: 1235 - RNA, 96 nt, Homo sapiens
accugaguaaccuuugcuaguccugacucagccaguacuggucuuagacuggugaugggucaggguucauauuuuggcaucucucucugggcaucu

SEQ ID NO: 1236 - RNA, 96 nt, Homo sapiens
ggagugaacucagauguggagcacuaccuuugugagcagugugacccaaggccuguggacaggguaagcugaaccucugauaaaacucugaucuau

SEQ ID NO: 1237 - RNA, 95 nt, Homo sapiens
gauaguaauaagaaagaugagcucauuguaauaugagcuucauuuauacauuucauauuaccauuagcucaucuuuuuuauuacuaccuucaaca

SEQ ID NO: 1238 - RNA, 98 nt, Homo sapiens
agaaugggcaaaugaacaguaaauuuggaggccuggggcccucccugcugcuggagaaguguuugcacgggugggccuugucuuugaaaggaggugga

SEQ ID NO: 1239 - RNA, 94 nt, Homo sapiens
gugugugugugugugugugguuauuuugguauaguagcucuagacucuauuauaguuuccugagcugcuguaccaaaauaccacaaacgggcug

SEQ ID NO: 1240 - RNA, 96 nt, Homo sapiens
gcuccaguaacaucuuaaaguaaauaugcaccaaaauuacuuuugguaaauacaguuuuggugcauauuuacuuuaggauguuacuggagcuccca

SEQ ID NO: 1241 - RNA, 97 nt, Homo sapiens
cuucauccaccaguccuccaggaacaucaaggaucuuaaacuuugccagagcuacaaaggcaaaguuuaagauccuugaaguuccugggggaaccau

SEQ ID NO: 1242 - RNA, 95 nt, Homo sapiens
agugaaauugcuaggucauauggucagucuacuuuuagaguaauugugaaacuguuuuucaaaguagcuguaccauuugcacucccuguggcaau

SEQ ID NO: 1243 - RNA, 79 nt, Homo sapiens
agcaaagaaguguguugcccucuaggaaauguguguugcucugauguaauuagguugacauacguuucccugguagcca

SEQ ID NO: 1244 - RNA, 94 nt, Homo sapiens
cgggcagcgggugccaggcacggugucagcaggcaacauggccgagaggccggggccuccgggcggcgccguguccgcgaccgcguacccugac

SEQ ID NO: 1245 - RNA, 94 nt, Homo sapiens
gcuaggcgugguggcgggcgccugugaucccaacuacucaggaggcuggggcagcagaaucgcuugaacccgggaggcgaagguugcagugagc

SEQ ID NO: 1246 - RNA, 98 nt, Homo sapiens
ggauucuuauaggacaguauguucuuccaggacagaacauucuuugcuauuuuguacuggaagaacaugcaaaacuaaaaaaaaaaaaaguuauugcu

SEQ ID NO: 1247 - RNA, 95 nt, Homo sapiens
gauauacacuauauuauguauaaauguauacacacuuccuauauguauccacauauauauaguguauauauuauacauguauagguguguauaug

SEQ ID NO: 1248 - RNA, 96 nt, Homo sapiens
gguauuguuagauuaauuuugugggacauuaacaacagcaucagaagcaacaucagcuuuaguuaaugaauccuggaaaguuaagugacuuuauuu

SEQ ID NO: 1249 - RNA, 97 nt, Homo sapiens
cuagauaaguuauuaggugggugcaaagguaauugcaguuuuucccauuauuuuaauugcgaaaacagcaauuaccuuugcaccaaccugauggagu

SEQ ID NO: 1250 - RNA, 96 nt, Homo sapiens
ccucaguaagaccaagcucagugugccauuuccuugucuguagccaugucuaugggcucuugaguuggccaucugagugagggccugcuuauucua

SEQ ID NO: 1251 - RNA, 95 nt, Homo sapiens
gucgaggccguggcccggaaguggucggggccgcugcgggcggaagggcgccugugcuucguccgcucggcgguggcccagccaggcccgcggga

SEQ ID NO: 1252 - RNA, 99 nt, Homo sapiens
uuuagcgguuucucccugaagugauguguaacugaucaggaucuacucaugucgucuuugguaaaguuaugucgcuugucagggugaggagaguuuuug

SEQ ID NO: 1253 - RNA, 96 nt, Homo sapiens
gggaccugcgugggugcgggcgugugagugugugugugugagugugugucgcuccggguccacgcucaugcacacacccacacgcccacacucagg

SEQ ID NO: 1254 - RNA, 94 nt, Homo sapiens
aauucagcccugccacuggcuuaugucaugaccuugggcuacucaggcugucugcacaaugagccaguuggacaggagcagugccacucaacuc

SEQ ID NO: 1255 - RNA, 98 nt, Homo sapiens
uacaauccaacgaggauucuaauuucuccacgucuuugguaauaagguuuggcaaagauguggaaaaauuggaauccucauucgauugguuauaacca

SEQ ID NO: 1256 - RNA, 96 nt, Homo sapiens
ugggggagugaagaguagauaaaauauugguaccugaugaaucugaggccagguuucaauacuuuaucugcucuucauuuccccauaucuacuuac

SEQ ID NO: 1257 - RNA, 96 nt, Homo sapiens
agauaaaucuauagacaaaauacaaucccggacaacaagaagcuccuauagcuccuguagcuucuugugcucuaggauuguauuuuguuuauauau

SEQ ID NO: 1258 - RNA, 98 nt, Homo sapiens
cauauuagguuaaugcaaaaguaaucgcgguuugugccagaugacgauuugaauuaauaaauucauuugguauaaaccgcgauuauuuuugcaucaac

SEQ ID NO: 1259 - RNA, 97 nt, Homo sapiens
auaaaauuuccaauuggaaccuaaugauucaucagacucagauauuuaaguuaacaguauuugagaaugaugaaucauuagguuccggucagaaauu

SEQ ID NO: 1260 - RNA, 96 nt, Homo sapiens
guuaugugaagguauucuuguguucucuagaucagugcuuuuagaaaauuugugugaucuaaagaacacaaagaauaccuacacagaaccaccugc

SEQ ID NO: 1261 - RNA, 98 nt, Homo sapiens
aucugugcucuuugauuacaguuguucaaccaguuacuaaucuaacuaauuguaacugguugaacaacugaacccaaagggugcaaaguagaaacauu

SEQ ID NO: 1262 - RNA, 75 nt, Homo sapiens
aacucacacauuaaccaaagaggaaggucccauuacugcagggaucuuagcaguacugggaccuaccucuuuggu

SEQ ID NO: 1263 - RNA, 97 nt, Homo sapiens
uagggugaccagccauuaugguuugccugggacugaggaauuugcugggauaugucaguuccaggccaaccaggcugguuggucucccugaagcaac

SEQ ID NO: 1264 - RNA, 94 nt, Homo sapiens
uggggugucugugcuauggcagcccuagcacacagauacgcccagagaaagccugaacguugggcguaucuguaugcuagggcugcuguaacaa

SEQ ID NO: 1265 - RNA, 97 nt, Homo sapiens
augggguaaaaccauuaugcauuguauuuuuaggucccaauacaugugggcccuaaaaauacaaugcauaaugguuuuucacucuuuaucuucuuau

SEQ ID NO: 1266 - RNA, 96 nt, Homo sapiens
cuccuaugcacccucuuuccauaggugaugagucacagggcucagggaaugugucugcaccugugacucaucaccaguggaaagcccaucccauau

SEQ ID NO: 1267 - RNA, 83 nt, Homo sapiens
agcuuagguaccaauuuggccacaauggguuagaacacuauuccauuguguucuuacccaccauggccaaaauugggccuaag

SEQ ID NO: 1268 - RNA, 99 nt, Homo sapiens
uccagccugugcccagcagccccugagaaccacgucugcucugagcuggguacugccuguucagaacaaaugccgguucccagacgcugccagcuggcc

SEQ ID NO: 1269 - RNA, 97 nt, Homo sapiens
uagccagucagaaaugagcuuauucauaaaagugcaguauggugaagucaaucuguaauuuuauguauaagcuagucucugauugaaacaugcagca

SEQ ID NO: 1270 - RNA, 95 nt, Homo sapiens
ucuuaucaaugagguagaccauggguucucauuguaauaguguagaauguugguuaacuguggacucccuggcucugucucaaaucuacugauuc

SEQ ID NO: 1271 - RNA, 97 nt, Homo sapiens
uauuaugccaugacauugugucaauaugcgaugauguguugugauggcacagcgucaucacguggugacgcaacaucaugacguaagacgucacaac

SEQ ID NO: 1272 - RNA, 100 nt, Homo sapiens
cccccagaaucugucaggcaccagccaggcauugcucagcccguuucccucugggggagcaaggaguggugcuggguuugucucugcugggguuucuccu

SEQ ID NO: 1273 - RNA, 96 nt, Homo sapiens
acggaagccugcacgcauuuaacaccagcacgcucaauguagucuuguaaggaacagguugaagugugccguggugugucuggaggaagcgccugu

SEQ ID NO: 1274 - RNA, 77 nt, Homo sapiens
agcacggccucuccgaagccugcccggcuccucgggaaccugccucccgcauggcagcugcugcccuucggaggccg

SEQ ID NO: 1275 - RNA, 97 nt, Homo sapiens
uacuuacucuacgugugugucacucgaugaccacugugaagacaguaaaauguacagugguucucuuguggcucaagcguaauguagaguacugguc

SEQ ID NO: 1276 - RNA, 97 nt, Homo sapiens
gcuugaugaugcugcugaugcuggcggugaucccgauggugugagcuggaaauggggugcuacgucaucguugucaucgucaucaucaucauccgag

SEQ ID NO: 1277 - RNA, 95 nt, Homo sapiens
aaagacaugcuguccacaguguguuugauaagcugacaugggacagggauucuuuucacuguugugucaguuuaucaaacccauacuuggaugac

SEQ ID NO: 1278 - RNA, 98 nt, Homo sapiens
aagucacgugcuguggcuccagcuucauaggaaggcucuugucugucaggcaguggaguuacuuacagacaagagccuugcucaggccagcccugccc

SEQ ID NO: 1279 - RNA, 79 nt, Homo sapiens
ugcaugaguucgucuuggucuaggauuguuggaggagucagaaaaacuaccccagggauccugaaguccuuugggugga

SEQ ID NO: 1280 - RNA, 98 nt, Homo sapiens
uucucacccccgccugacacgggcgacagcugcggcccgcuguguucacucgggccgagugcgucuccugucaggcaagggagagcagagccccccug

SEQ ID NO: 1281 - RNA, 97 nt, Homo sapiens
gauugaugcuguugguuuggugcaaaaguaauugcagugcuucccauuuaaaaguaauggcacacacugcaauuacuuuugcuccaacuuaauacuu

SEQ ID NO: 1282 - RNA, 94 nt, Homo sapiens
agagcaucgugcuugaccuuccacgcucucguguccacuagcaggcagguuuucugacacaggcugcggaauucaggacagugcaucauggaga

SEQ ID NO: 1283 - RNA, 83 nt, Homo sapiens
gcccuagcuugguucuaaaucccauggugccuucuccuugggaaaaacagagaaggcacuaugagauuuagaaucaaguuagg

SEQ ID NO: 1284 - RNA, 96 nt, Homo sapiens
uguauccuugguuuuuaguaguuuuacuaugaugaggugugccauccaccccaucauaguaaacuacugaaaaucaaagauacaagugccugacca

SEQ ID NO: 1285 - RNA, 96 nt, Homo sapiens
uugccuaaagucacacagguuauagaucuggauuggaacccagggagccagacugccuggguucaaauccagaucuauaacuugugugacuuuggg

SEQ ID NO: 1286 - RNA, 100 nt, Homo sapiens
gggccaaggugggccaggggugguguugggacagcuccguuuaaaaaggcaucuccaagagcuuccaucaaaggcugccucuuggugcagcacagguaga

SEQ ID NO: 1287 - RNA, 95 nt, Homo sapiens
ugcucggcuguuccuaggguguuucucucaucucuggucuauaauggguuaaauaguagagaugagggcaacacccuaggaacagcagaggaacc

SEQ ID NO: 1288 - RNA, 96 nt, Homo sapiens
ucuauuugucuuaggugagcuaaaugugugcugggacacauuugagccaaaugucccagcacacauuuagcucacauaagaaaaauggacucuagu

SEQ ID NO: 1289 - RNA, 67 nt, Homo sapiens
aaaauggugagagcguugaggggaguuccagacggagaugcgaggaccccucggggucugacccaca

SEQ ID NO: 1290 - RNA, 100 nt, Homo sapiens
ucccaucuggacccugcugggcagggcuucugagcuccuuagcacuagcaggaggggcuccaggggcccucccuccauggcagccaggacaggacucuca

SEQ ID NO: 1291 - RNA, 95 nt, Homo sapiens
ggugagugcguuuccaagugugaagggacccuuccuguagugucuuauauacaauacaguaggaauguuccuucuuugccacucauacaccuuua

SEQ ID NO: 1292 - RNA, 90 nt, Homo sapiens
ucuaagaaacgcaguggucucugaagccugcaggggcaggccagcccugcacugaacgccuguucuugccagguggcagaagguugcugc

SEQ ID NO: 1293 - RNA, 96 nt, Homo sapiens
cucgggaggggcgggagggggguccccggugcucggaucucgagggugcuuauuguucgguccgagccugggucucccucuuccccccaacccccc

SEQ ID NO: 1294 - RNA, 97 nt, Homo sapiens
uuagguaauuccuccacucaaaacccuucagugacuuccaugacaugaaauaggaagucauuggaggguuugagcagaggaaugaccuguuuuaaaa

SEQ ID NO: 1295 - RNA, 97 nt, Homo sapiens
caucauaaggagccuagacuucccauuugaagguggccauuuccuaccaccuucaaaugguaaguccaggcuccuucugauucaauaaaugaggagc

SEQ ID NO: 1296 - RNA, 98 nt, Homo sapiens
cucuuguucacagccaaacucuacuuguccuucugaguguaauuacguacaugcaguagcucaggagacaagcagguuuacccuguggaugagucuga

SEQ ID NO: 1297 - RNA, 99 nt, Homo sapiens
cgcccaccucagccucccaaaaugcugggauuacaggcaugagccacugcggucgaccaugaccuggacauguuugugcccaguacugucaguuugcag

SEQ ID NO: 1298 - RNA, 95 nt, Homo sapiens
auauauaucuauaucuagcuccguauauauauauauauauauauagauaucuccauauauauggagauagauauagaaauaaaacaagcaaagaa

SEQ ID NO: 1299 - RNA, 96 nt, Homo sapiens
uagauugaggaaggggcugagugguaggcggugcugcugugcucugaugaagacccauguggcuagcaacagcgcuuaccuuuugucucugggucc

SEQ ID NO: 1300 - RNA, 96 nt, Homo sapiens
agagaagcuggacaaguacuggucucagcagauugaggagagcaccacaguggucaucacacagucugcugagguuggagcugcugagaugacacu

SEQ ID NO: 1301 - RNA, 98 nt, Homo sapiens
guacacaguagaagcaucccuugcaggggcuguuggguugcauccuaagcugugcuggagcuucccgauguacucuguagaugucuuugcaccuucug

SEQ ID NO: 1302 - RNA, 97 nt, Homo sapiens
aaugcuguuucaagguaguaccaguaccuuguguucaguggaaccaagguaaacacaagguauugguauuaccuugagauagcauuacaccuaagug

SEQ ID NO: 1303 - RNA, 85 nt, Homo sapiens
aggguagagggaugagggggaaaguucuauaguccuguaauuagaucucaggacuauagaacuuucccccucaucccucugcccu

SEQ ID NO: 1304 - RNA, 94 nt, Homo sapiens
acugauauauuugucuuauuugagagcugaggaguauuuuuaugcaaucugaaugaucucagcugucugaaaaugucuucaauuuuaaaggcuu

SEQ ID NO: 1305 - RNA, 97 nt, Homo sapiens
uacuuauuacugguagugagucucuaagaaaagaggaggugguuguuuuccuccucuuuucuuugagacucacuaccaauaauaagaaauacuacua

SEQ ID NO: 1306 - RNA, 95 nt, Homo sapiens
auagcuguugugucacuuccucaugcugacauauuuacuagaggguaaaauuaauaaccuucuaguaagaguggcagucgaagggaagggcucau

SEQ ID NO: 1307 - RNA, 97 nt, Homo sapiens
ucccuuucccaggggaggggcuggguuuacguugggagaacuuuuacggugaaccaggagguucucccaacguaagcccagccccuccccucugccu

SEQ ID NO: 1308 - RNA, 97 nt, Homo sapiens
aacuuaacaucaugcuaccucuuuguaucauauuuuguuauucuggucacagaaugaccuaguauucuguaccagggaagguaguucuuaacuauau

SEQ ID NO: 1309 - RNA, 75 nt, Homo sapiens
guggggagccugguuagaccuggcccagaccucagcuacacaagcugauggacugagucaggggccacacucucc

SEQ ID NO: 1310 - RNA, 94 nt, Homo sapiens
cgccuccuaccgcagugcuugacgggaggcggagcggggaacgaggccgucggccauuuugugucugcuuccugugggacguggugguagccgu

SEQ ID NO: 1311 - RNA, 98 nt, Homo sapiens
aaccucucuuagccucuguuucuuuauugcgguagauacuauuaaccuaaaaugagaaggcuaauaguaucuaccacaauaaaauuguugugaggaua

SEQ ID NO: 1312 - RNA, 97 nt, Homo sapiens
aaacccacaccacugcauuuuggccaucgaggguuggggcuuggugucaugccccaagauaaccagcaccccaacuuuggacagcauggauuagucu

SEQ ID NO: 1313 - RNA, 98 nt, Homo sapiens
cagagaggagcugccacuugggcacugaaacaauguccauuaggcuuuguuauggaaacuucuccugaucauuguuuuguguccauugagcuuccaau

SEQ ID NO: 1314 - RNA, 99 nt, Homo sapiens
uggcggccugggcgggagcgcgcgggcggggccggccccgcugccuggaauuaaccccgcugugcuugcucgucccgcccgcagcccuaggcggcgucg

SEQ ID NO: 1315 - RNA, 99 nt, Homo sapiens
uggcuaagguguuggcucgggcuccccacugcaguuacccuccccucggcguuacugagcacugggggcuuucgggcucugcgucugcacagauacuuc

SEQ ID NO: 1316 - RNA, 100 nt, Homo sapiens
gugagcgggcgcggcagggaucgcgggcggguggcggccuagggcgcggagggcggaccgggaauggcgcgccgugcgccgccggcguaacugcggcgcu

SEQ ID NO: 1317 - RNA, 98 nt, Homo sapiens
uggccgacggggcgcgcgcggccuggaggggcggggcggacgcagagccgcguuuagucuaucgcugcgguugcgagcgcuguagggagccugugcug

SEQ ID NO: 1318 - RNA, 96 nt, Homo sapiens
gugacccugggcaaguuccugaagaucagacacaucagaucccuuaucuguaaaaugggcaugauccaggaaccugccucuacgguugccuugggg

SEQ ID NO: 1319 - RNA, 99 nt, Homo sapiens
ugggugaaaggaaggaaagacauaggauagagucaccucuguccucuguccucuaccuauagaggugacuguccuaugucuuuccuuccucuuaccccu

SEQ ID NO: 1320 - RNA, 97 nt, Homo sapiens
aucugaguugggagggucccucuccaaaugugucuuggggugggggaucaagacacauuuggagagggaaccucccaacucggccucugccaucauu

SEQ ID NO: 1321 - RNA, 77 nt, Homo sapiens
gaguugggagguucccucuccaaaugugucuugaucccccaccccaagacacauuuggagagggacccucccaacuc

SEQ ID NO: 1322 - RNA, 97 nt, Homo sapiens
accaagugauauucauugucuaccugagcuagaauacaaguaguuggcgucuucagagacacuuguaugcuagcucagguagauauugaaugaaaaa

SEQ ID NO: 1323 - RNA, 94 nt, Homo sapiens
uuuuuuuuuaguauuuuuccaucaguguucauaaggaauguugcucuguaguuuucuuauaguguggcuuucuuagagcaaagaugguucccua

SEQ ID NO: 1324 - RNA, 61 nt, Homo sapiens
ugggcuaagggagaugauuggguagaaaguauuauucuauucauuugccucccagccuaca

SEQ ID NO: 1325 - RNA, 94 nt, Homo sapiens
caguuccuaacaggccucagaccaguaccggucuguggccuggggguugaggaccccugcucuaggcugguacugcugaugcuuaaaaagagag

SEQ ID NO: 1326 - RNA, 94 nt, Homo sapiens
gaucaggagucugccaguggagucagcacaccugcuuuucaccugugaucccaggagaggaagcagcugccucugaggccucaggcucaguggc

SEQ ID NO: 1327 - RNA, 96 nt, Homo sapiens
aggaaguguuggccuguggcugcacucacuuccuucagccccaggaagccuuggucgggggcaggagggagggucaggcagggcugggggccugac

SEQ ID NO: 1328 - RNA, 94 nt, Homo sapiens
aucacagacaccuccaagugugcagggcacuggugggggccggggcaggcccagcgaaagugcaggaccuggcacuuagucggaagugagggug

SEQ ID NO: 1329 - RNA, 97 nt, Homo sapiens
ggccuagccaaauacuguauuuuugaucgacauuugguugaaaaauaucuauguauuaguaaaccuguguuguucaagaguccacuguguuuugcug

SEQ ID NO: 1330 - RNA, 96 nt, Homo sapiens
cagugcuggggucucaggaggcagcgcucucaggacgucaccaccauggccugggcucugcuccuccucacccuccucacucagggcacaggugau

SEQ ID NO: 1331 - RNA, 97 nt, Homo sapiens
aaucuaucacugcuuuuuaggauaagcuugacuuuuguucaaauaaaaaugcaaaaggaaaguguauccuaaaaggcaaugacaguuuaauguguuu

SEQ ID NO: 1332 - RNA, 98 nt, Homo sapiens
acgaauggcuaugcacugcacaacccuaggagagggugccauucacauagacuauaauugaauggcgccacuaggguugugcagugcacaaccuacac

SEQ ID NO: 1333 - RNA, 96 nt, Homo sapiens
uucauuccuucaguguugaaacaaucucuacugaaccagcuucaaacaaguucacuggaguuuguuucaauauugcaagaaugauaagauggaagc

SEQ ID NO: 1334 - RNA, 81 nt, Homo sapiens
ggguaaguggaaagauggugggccgcagaacaugugcugaguucgugccauaugucugcugaccaucaccuuuagaagccc

SEQ ID NO: 1335 - RNA, 97 nt, Homo sapiens
aacuaugcaaggauauuugaggagagguuauccguguuauguucgcuucauucaucaugaauaauacaugguuaaccucuuuuugaauaucagacuc

SEQ ID NO: 1336 - RNA, 78 nt, Homo sapiens
cugaaauagguugccugugagguguucacuuucuauaugaugaauauuauacagucaaccucuuuccgauaucgaauc

SEQ ID NO: 1337 - RNA, 98 nt, Homo sapiens
guguaguagagcuaggaggagaggguccuggagaagcguggaccgguccggguggguuccggcagguucucacccucucuaggccccauucuccucug

SEQ ID NO: 1338 - RNA, 100 nt, Homo sapiens
gcucgguugccgugguugcgggcccugcccgcccgccagcucgcugacagcacgacucagggcggagggaaguagguccguuggucggucgggaacgagg

SEQ ID NO: 1339 - RNA, 97 nt, Homo sapiens
uaccgacccucgauuugguucaggaccuucccugaaccaaggaagagucacagucucuuccuugguucagggaggguccccaacaauguccucaugg

SEQ ID NO: 1340 - RNA, 97 nt, Homo sapiens
cugcuccuucucccauacccauugcauaucggaguugugaauucucaaaacaccuccugugugcauggauuacaggagggugagccuugucaucgug

SEQ ID NO: 1341 - RNA, 89 nt, Homo sapiens
ggagaggcugugcuguggggcaggcgcaggccugagcccugguuucgggcugccugggucucuggccugcgcgugacuuugggguggcu

SEQ ID NO: 1342 - RNA, 95 nt, Homo sapiens
gcuguugaggcugcgcagccaggcccugacggugggguggcugcgggccuucugaaggucucccacguuguggcccagcagcgcagucacguugc

SEQ ID NO: 1343 - RNA, 93 nt, Homo sapiens
ccuuccggcgucccaggcggggcgccgcgggaccgcccucgugucuguggcggugggaucccgcggccguguuuuccugguggcccggccaug

SEQ ID NO: 1344 - RNA, 115 nt, Homo sapiens
ggugccgagggccguccggcauccuaggcgggucgcugcgguaccucccuccugucuguggcggugggaucccguggccguguuuuccugguggcccggccgugccugagguuuc

SEQ ID NO: 1345 - RNA, 82 nt, Homo sapiens
gaacauugaaacuggcuagggaaaaugauuggauagaaacuauuauucuauucauuuauccccagccuacaaaaugaaaaaa

SEQ ID NO: 1346 - RNA, 72 nt, Homo sapiens
ucuccucgaggggucucugccucuacccaggacucuuucaugaccaggaggcugaggccccucacaggcggc

SEQ ID NO: 1347 - RNA, 66 nt, Homo sapiens
gguaagugcgccucgggugagcaugcacuuaauguggguguaugucacucggcucggcccacuacc

SEQ ID NO: 1348 - RNA, 98 nt, Homo sapiens
guuuagggguggaccugaugucccugaguguauguggugaaccugaauuugccuuggguuuccucauauucauucaggagugucaguugccccuucac

SEQ ID NO: 1349 - RNA, 118 nt, Homo sapiens
gcaggugaacuggcaggccaggaagaggaggaagcccuggaggggcuggaggugauggauguuuuccuccgguucucagggcuccaccucuuucgggccguagagccagggcuggugc

SEQ ID NO: 1350 - RNA, 73 nt, Homo sapiens
cccagggucuggugcggagagggcccacaguggacuuggugacgcuguaugcccucaccgcucagccccuggg

SEQ ID NO: 1351 - RNA, 67 nt, Homo sapiens
gcaugacucuucaaccucaggacuugcagaauuaauggaaugcuguccuaagguuguugaguugugc

SEQ ID NO: 1352 - RNA, 88 nt, Homo sapiens
aacugcccucaaggagcuuacaaucuagcuggggguaaaugacuugcacaugaacacaacuagacugugagcuucuagagggcaggga

SEQ ID NO: 1353 - RNA, 76 nt, Homo sapiens
acugacuuugagucucuccucagggugcugcaggcaaagcuggggacccagggagagacguaagugaggggagaug

SEQ ID NO: 1354 - RNA, 70 nt, Homo sapiens
ggccgcggcgcgcaagauggcggcgggcccgggcaccgccccuuccgccccgccgggcgucgcacgaggc

SEQ ID NO: 1355 - RNA, 110 nt, Homo sapiens
ccggaucucacacggugguguuaauaucucgcuggggccuccaaaauguugugcccagggguguuagagaaaacaccacacuuugagaugaauuaagaguccuuuauuag

SEQ ID NO: 1356 - RNA, 98 nt, Homo sapiens
uugggcaaggugcggggcuagggcuaacagcagucuuacugaagguuuccuggaaaccacgcacaugcuguugccacuaaccucaaccuuacucgguc

SEQ ID NO: 1357 - RNA, 88 nt, Homo sapiens
gccuggauacaugagaugguugaccagagagcacacgcuuuauuugugccguuugugaccugguccacuaacccucaguaucuaaugc

SEQ ID NO: 1358 - RNA, 91 nt, Homo sapiens
uaauaaauuaaaugccuaaacuggcagagugcaaacaauuuugacucagaucuaaauguuugcacuggcuguuuaaacauuuaauuuguua

SEQ ID NO: 1359 - RNA, 80 nt, Homo sapiens
ggcgcgucgccccccucaguccaccagagcccggauaccucagaaauucggcucugggucuguggggagcgaaaugcaac

SEQ ID NO: 1360 - RNA, 59 nt, Homo sapiens
ggaggagcagcagggugaaacugacacaguucuggugaguuucacuuugcugcuccucc

SEQ ID NO: 1361 - RNA, 83 nt, Homo sapiens
ggcccggcuccgggucucggcccguacaguccggccggccaugcuggcggggcuggggccggggccgagcccgcggcggggcc

SEQ ID NO: 1362 - RNA, 85 nt, Homo sapiens
aaucuaggaggcaggugcucacuuguccuccuccaugcuuggaaaaugcagggaggaggccauaguggcaacuguuaccaugauu

SEQ ID NO: 1363 - RNA, 114 nt, Homo sapiens
uuuaggcgcugaugaaaguggaguucaguagacagcccuuuucaagcccuacgagaaacugggguuucuggaggagaaggaaggugaugaaggaucuguucucgugagccugaa

SEQ ID NO: 1364 - RNA, 111 nt, Homo sapiens
gcauccucaggaccugggcuugggugguaggaggaauuggugcuggucuuucauuuuggauuugacuccagccccacagccucagccaccccagccaauugucauaggagc

SEQ ID NO: 1365 - RNA, 109 nt, Homo sapiens
gcuuuuauauuguagguuuuugcucaugcaccaugguugucugagcaugcagcaugcuugucugcucauaccccaugguuucugagcaggaaccuucauugucuacugc

SEQ ID NO: 1366 - RNA, 118 nt, Homo sapiens
gccuuggugcugauuccugggcucugaccugagaccucuggguucugagcugugauguugcucucgagcugggaucuccggggucuugguucagggccggggccucuggguuccaagc

SEQ ID NO: 1367 - RNA, 98 nt, Homo sapiens
aggagccaccuuccgagccuccaguaccacgugucagggccacaugagcugggccucgugggccugauguggugcuggggccucaggggucugcucuu

SEQ ID NO: 1368 - RNA, 94 nt, Homo sapiens
guucuguuauuugcagucaguaacaaagauucauccuuguguccaucaugcaacaaggagaaucuuugucacuuaguguaauuaauagcuggac

SEQ ID NO: 1369 - RNA, 77 nt, Homo sapiens
gugugcauuugcaggaacuugugagucuccuauugaaaaugaacaggagacugaugaguucccgggaacacccacaa

SEQ ID NO: 1370 - RNA, 78 nt, Homo sapiens
uuagcccugcggccccacgcaccaggguaagagagacucucgcuuccugcccuggcccgagggaccgacuggcugggc

SEQ ID NO: 1371 - RNA, 76 nt, Homo sapiens
uuagugguacuauaccucaguuuuaucagguguucuuaaaaucaccuggaaacacugagguugugucucacugaac

SEQ ID NO: 1372 - RNA, 81 nt, Homo sapiens
ugaagugcuguggauuucuuugugaaucaccauaucuaagcuaaugugguggugguuuacaaaguaauucauagugcuuca

SEQ ID NO: 1373 - RNA, 86 nt, Homo sapiens
guagaggagauggcgcaggggacacgggcaaagacuuggggguuccugggacccucagacguguguccucuucucccuccucccag

SEQ ID NO: 1374 - RNA, 74 nt, Homo sapiens
ccgcacucucuccauuacacuacccugccucuucuccaugagaggcagcgggguguaguggauagagcacgggu

SEQ ID NO: 1375 - RNA, 79 nt, Homo sapiens
gugcagauccuugggagcccuguuagacucuggauuuuacacuuggagugaacgggcgccaucccgaggcuuugcacag

SEQ ID NO: 1376 - RNA, 77 nt, Homo sapiens
ggcagugcucuacucaaaaagcugucagucacuuagauuacaugugacugacaccucuuugggugaaggaaggcuca

SEQ ID NO: 1377 - RNA, 79 nt, Homo sapiens
gugcuuaaagaauggcuguccguaguauggucucuauauuuaugaugauuaauaucggacaaccauuguuuuaguaucc

SEQ ID NO: 1378 - RNA, 77 nt, Homo sapiens
ggaagugcccuacuuggaaaggcaucaguugcuuagauuacauguaacuauucccuuucugaguagaguaagucuua

SEQ ID NO: 1379 - RNA, 79 nt, Homo sapiens
ccuuaauccuugcaacgaaccugagccacugauucaguaaaauacucaguggcacauguuuguugugagggucaaaaga

SEQ ID NO: 1380 - RNA, 79 nt, Homo sapiens
ccuuaauccuugcaacuuaccugagucauugauucaguaaaacauucaauggcacauguuuguuguuagggucaaaaga

SEQ ID NO: 1381 - RNA, 75 nt, Homo sapiens
gcagugccuuacucagaaaggugccagucacuuacacuacaugucacuguguccuuucugcguagaguaaggcuc

SEQ ID NO: 1382 - RNA, 77 nt, Homo sapiens
ugcaaugcccuacucagaaaggugccauuuauguagauuuuaugucacuggcuccuuucuggguagagcaaggcuca

SEQ ID NO: 1383 - RNA, 75 nt, Homo sapiens
guaguuguucuacagaagaccuggauguguaggagcuaagacacacuccaggggagcuguggaagcaguaacacg

SEQ ID NO: 1384 - RNA, 56 nt, Homo sapiens
acuagugagggacagaaccaggauucagacucagguccaugggccuggaucacugg

SEQ ID NO: 1385 - RNA, 81 nt, Homo sapiens
auggcguuuucccucucccuguccuggacuggggucagacugugccccgaggagaagcagcagagaauaggacuacgucau

SEQ ID NO: 1386 - RNA, 53 nt, Homo sapiens
aauagagucuugugaugucuugcuuaagggccauccaaccuagagucuacaac

SEQ ID NO: 1387 - RNA, 77 nt, Homo sapiens
acuugggucaguucagagguccucggggcgcgcgucgagucagccgugugcgcagggagaccucucccacccacagu

SEQ ID NO: 1388 - RNA, 83 nt, Homo sapiens
agaaauaaggcuucugucuacuacuggagacacugguaguauaaaacccagagucuccaguaauggacgggagccuuauuucu

SEQ ID NO: 1389 - RNA, 91 nt, Homo sapiens
ggcgggggcgcgggcggcaguggcgggagcggccccucggccauccuccgucugcccaguuaccgcuuccgcuaccgccgccgcucccgcu

SEQ ID NO: 1390 - RNA, 98 nt, Homo sapiens
ucaaggccacugggacaguagagggaggaaucgcagaaaucacuccaggagcaacugagagaccuugcuucuacuuuaccagguccugcuggcccaga

SEQ ID NO: 1391 - RNA, 86 nt, Homo sapiens
agcacugcccccggugagucaggguggggcuggcccccugcuucgugcccauccgcgcucugacucucugcccaccugcaggagcu

SEQ ID NO: 1392 - RNA, 83 nt, Homo sapiens
gaagguguaccaugugcccuuaaaggugaacccagugcaccuucaugaaccgugguacaccuuuaagaacuugguaugccuuc

SEQ ID NO: 1393 - RNA, 82 nt, Homo sapiens
ugugggcagggcccuggggagcugaggcucuggggguggccggggcugacccugggccucugcuccccagugucugaccgcg

SEQ ID NO: 1394 - RNA, 94 nt, Homo sapiens
gugaggugugggcccggccccaggagcggggccugggcagccccguguguugaggaaggaaggcagggcccccgcuccccgggccugaccccac

SEQ ID NO: 1395 - RNA, 117 nt, Homo sapiens
cacggaagaggacacacccggcuguguggacaugugcccagggcccgggacagcgccacggaagaggacgcacccggcugugugcacaugugcccagggcccgggacagcgccacgg

SEQ ID NO: 1396 - RNA, 117 nt, Homo sapiens
cacggaagaggacgcacccggcugugugcacaugugcccagggcccgggacagcgccacggaagaggacgcacccggcugugugcacaugugcccagggcccgggacagcgccacgg

SEQ ID NO: 1397 - RNA, 117 nt, Homo sapiens
cacggaagaggacgcacccggcugugugcacaugugcccagggcccgggacagcgccacggaagaggacgcacccggcugugugcacaugugcccagggcccgggacagcgccaugg

SEQ ID NO: 1398 - RNA, 117 nt, Homo sapiens
cauggaagaggacgcacccggcugugugcacaugugcccagggcccgggacagcgccacggaagaggacgcacccggcugugugcacaugugcccagggcccgggacagcgccacgg

SEQ ID NO: 1399 - RNA, 86 nt, Homo sapiens
auuaggagaguaucuucucuguuuuggccauguguguacucacagccccucacacauggccgaaacagagaaguuacuuuccuaau

SEQ ID NO: 1400 - RNA, 94 nt, Homo sapiens
gggacguucugagcucggggugggggacguuugccggucacugcugcuggcgcccugacuguugccguccuccagccccacucaaaggcauccc

SEQ ID NO: 1401 - RNA, 88 nt, Homo sapiens
guuccagacacaucucaucugauauacaauauuuucuuaaauuguauaaagagaaauuauuguacaucggaugagcugugucugggau

SEQ ID NO: 1402 - RNA, 91 nt, Homo sapiens
gcguuggcuggcagaggaagggaaggguccagggucagcugagcaugcccucagguugcucacuguucuucccuagaaugucaggugaugu

SEQ ID NO: 1403 - RNA, 91 nt, Homo sapiens
ggcuggaaaggaagaagcauucuuucauugguugguguguauugccuugucaaccaauaagaggaugccauuuauccuuuucugacuagcu

SEQ ID NO: 1404 - RNA, 69 nt, Homo sapiens
gcugcuggacccacccggccgggaauagugcuccugguuguuuccggcucgcgugggugugucggcggc

SEQ ID NO: 1405 - RNA, 81 nt, Homo sapiens
uccacugcugccgccgucgccgccacccgagccggagcgggcugggccgccaaggcaagaugguggacuacagcguguggg

SEQ ID NO: 1406 - RNA, 97 nt, Homo sapiens
gggacuugucacugccugucuccucccucuccagcagcgacuggauucuggaguccaucuagagggucuugggagggaugugacuguugggaagccc

SEQ ID NO: 1407 - RNA, 89 nt, Homo sapiens
auuauucaaaugcucggagacacagaacauuagagaagacaggaguucacuguaggugauggugagagugggcauggagcaggagugcc

SEQ ID NO: 1408 - RNA, 99 nt, Homo sapiens
cuugcagaacgaggugaaggaggugguucugcucagcagucaacaguggccacaucuccaccugcagcgacuugauggcuuccguguccuuuucguggg

SEQ ID NO: 1409 - RNA, 99 nt, Homo sapiens; identical to SEQ ID NO: 1408

SEQ ID NO: 1410 - RNA, 99 nt, Homo sapiens; identical to SEQ ID NO: 1408

SEQ ID NO: 1411 - RNA, 86 nt, Homo sapiens
uuugguacuugaagagaggauacccuuuguauguucacuugauuaauggcgaauauacagggggagacucuuauuugcguaucaaa

SEQ ID NO: 1412 - RNA, 86 nt, Homo sapiens
uuugguacuuaaagagaggauacccuuuguauguucacuugauuaauggcgaauauacagggggagacucucauuugcguaucaaa

SEQ ID NO: 1413 - RNA, 78 nt, Homo sapiens
guagcugaggggaugguagaccggugacgugcacuucauuuacgauguaggucacccguuugacuauccaccagcgcc

SEQ ID NO: 1414 - RNA, 88 nt, Homo sapiens
acuuccugguauuugaagaugcgguugaccaugguguguacgcuuuauuugugacguaggacacauggucuacuucuucucaauauca

SEQ ID NO: 1415 - RNA, 76 nt, Homo sapiens
ugcuacuucuccugagccauucugagccucaaucacuugccagagagauugguucaggaauuugucagggauagcc

SEQ ID NO: 1416 - RNA, 83 nt, Homo sapiens
ccugcugcagaggugccagcugcagugggggaggcacugccagggcugcccacucugcuuagccagcaggugccaagaacagg

SEQ ID NO: 1417 - RNA, 85 nt, Homo sapiens
uccuccccggagccaggaugcagcucaagccacagcaggguguuuagcgcucuucaguggcuccagauuguggcgcuggugcagg

SEQ ID NO: 1418 - RNA, 67 nt, Homo sapiens
accucguggccuggucuccauuauuugagaugaguuacaucuuggaggugaggacgugccucguggu

SEQ ID NO: 1419 - RNA, 63 nt, Homo sapiens
gaaggccucugcaggguuugcuuugagguacuuccuuccugucaacccuguucuggagucugu

SEQ ID NO: 1420 - RNA, 59 nt, Homo sapiens
caguguucauguagauguuuaagcucuugcaguagguuuuugcaagcuagugaacgcug

SEQ ID NO: 1421 - RNA, 87 nt, Homo sapiens
gcagggcuggcagggaggcugggaggggcuggcugggucugguagugggcaucagcuggcccucauuucuuaagacagcacuucugu

SEQ ID NO: 1422 - RNA, 73 nt, Homo sapiens
caccggcagaaucacuguucagacaggcggagacgggucuuucucgcccucugaugagucaccacuguggugg

SEQ ID NO: 1423 - RNA, 85 nt, Homo sapiens
gugaggacucgggagguggaggguggugccgccggggccgggcgcuguuucagcucgcuucuccccccaccuccucucuccucag

SEQ ID NO: 1424 - RNA, 90 nt, Homo sapiens
guggguacggcccagugggggggagagggacacgcccugggcucugcccagggugcagccggacugacugagccccugugccgcccccag

SEQ ID NO: 1425 - RNA, 75 nt, Homo sapiens
gugagggcaugcaggccuggauggggcagcugggaugguccaaaaggguggccucaccagcccuguguucccuag

SEQ ID NO: 1426 - RNA, 88 nt, Homo sapiens
guggggccaggcgguggugggcacugcuggggugggcacagcagccaugcagagcgggcauuugaccccgugccacccuuuuccccag

SEQ ID NO: 1427 - RNA, 73 nt, Homo sapiens
gugggcgggggcagguguguggugggugguggccugcggugagcagggcccucacaccugccucgccccccag

SEQ ID NO: 1428 - RNA, 69 nt, Homo sapiens
guggguaggguuugggggagagcgugggcugggguucagggacacccucucaccacugcccucccacag

SEQ ID NO: 1429 - RNA, 92 nt, Homo sapiens
gucagugucugggcggacagcugcaggaaagggaagaccaaggcuugcugucuguccagucugccacccuacccugucuguucuugccacag

SEQ ID NO: 1430 - RNA, 82 nt, Homo sapiens
gugagugggaggccagggcacggcagggggagcugcagggcuaugggaggggccccagcgucugagcccuguccucccgcag

SEQ ID NO: 1431 - RNA, 82 nt, Homo sapiens; identical to SEQ ID NO: 1430

SEQ ID NO: 1432 - RNA, 84 nt, Homo sapiens
gugagugugggguggcuggggggggggggggggggccggggacggcuugggccugccuagucggccugaccacccaccccacag

SEQ ID NO: 1433 - RNA, 102 nt, Homo sapiens
gugagugacaggggaaauggggauggacuggaagugggcagcauggagcugaccuucaucauggcuuggccaacauaaugccucuuccccuugucucuccag

SEQ ID NO: 1434 - RNA, 102 nt, Homo sapiens
gugggagggcccaggcgcgggcagggguggggguggcagagcgcugucccgggggcggggccgaagcgcggcgaccguaacuccuucugcuccgucccccag

SEQ ID NO: 1435 - RNA, 83 nt, Homo sapiens
gugagugggagccccagugugugguuggggccauggcgggugggcagcccagccucugagccuuccucgucugucugccccag

SEQ ID NO: 1436 - RNA, 93 nt, Homo sapiens
cuaaaacuggaucaauuauaggagugaaauaaagguccaucuccugccuauuuauuacuuugcuuugguaauaaaucuauuuuuaaaagaacc

SEQ ID NO: 1437 - RNA, 85 nt, Homo sapiens
aucuuauuccgagcauuccaguaacuuuuuuguguauguacuuagcuguacuauaaguaguugguuuguaugagaugguuaaaaa

SEQ ID NO: 1438 - RNA, 85 nt, Homo sapiens; identical to SEQ ID NO: 1437

SEQ ID NO: 1439 - RNA, 85 nt, Homo sapiens; identical to SEQ ID NO: 1437

SEQ ID NO: 1440 - RNA, 70 nt, Homo sapiens
auuuauguauaggccuuuagaucaucugauguugaauacucuuuaagugaucuaaaggccuacauauaaa

SEQ ID NO: 1441 - RNA, 69 nt, Homo sapiens
uuuauauguaggccuuuagaucacuuaaagaguauucaacaucagaugaucuaaaggccuauacauaaa

SEQ ID NO: 1442 - RNA, 73 nt, Homo sapiens
uguauccuugaauggauuuuuggagcaggaguggacaccugacccaaaggaaaucaauccauaggcuagcaau

SEQ ID NO: 1443 - RNA, 136 nt, Homo sapiens
ccgcuugccucgcccagcgcagccccggccgcugggcgcacccgucccguucguccccggacguugcucucuaccccgggaacgucgagacuggagcgcccgaacugagccaccuucgcggaccccgagagcggcg

SEQ ID NO: 1444 - RNA, 106 nt, Homo sapiens
uuuaccuucuuguauaagcacugugcuaaaauugcagacacuaggaccaugucuugguuuuugcaauaaugcuagcagaguacacacaagaagaaaaguaacagca

SEQ ID NO: 1445 - RNA, 66 nt, Homo sapiens
gggaggagggaggagaugggccaaguucccucuggcuggaacgcccuucccccccuucuucaccug

SEQ ID NO: 1446 - RNA, 113 nt, Homo sapiens
cugucccgcuggccuggcaggugacggugcuggauguggccuuuuugccuuuucuaaaggccacauuuuccagcccauucaaccuuccagagcccucugaaguggccacaggc

SEQ ID NO: 1447 - RNA, 70 nt, Homo sapiens
guggacucuagcugccaaaggcgcuucuccuucugaacagagcgcuuugcucagccaguguagacauggc

SEQ ID NO: 1448 - RNA, 65 nt, Homo sapiens
agaaagaaggaaauugaauucauuuagaaaagagaauuccaaaugagcuuaauuuccuuuuuucu

SEQ ID NO: 1449 - RNA, 105 nt, Homo sapiens
agcagcaagagauagaauccaaaagagaagaagaucagccugcagauguggacugcuaaaugcaggcugaucuucuccccuuugggauucucuuaugagaagcca

SEQ ID NO: 1450 - RNA, 97 nt, Homo sapiens
ggugggaggauugcuugagccuggaagcuggagccugcagugaacuaucauugugccacuguacuccagccuaggcaacaaaaugaaauccugucua

SEQ ID NO: 1451 - RNA, 63 nt, Homo sapiens
cugagccuggaagcuggagccugcagugagcuaugaucaugucccuguacucuagccugggca

SEQ ID NO: 1452 - RNA, 113 nt, Homo sapiens
auuggaaauccuuugaguugcuucucaaggaugagcaaagaaaguagauuuuuuagauucuaaagaaacuaucuucuuugcucauccuugagaagcaacuccuuauccauuaa

SEQ ID NO: 1453 - RNA, 63 nt, Homo sapiens
uacggaugagcaaagaaagugguuucuuaaaauggaaucuacucuuugugaagaugcugugaa

SEQ ID NO: 1454 - RNA, 67 nt, Homo sapiens
ucuuacggaugagcaaagaaagugguuugcgccucaagaaaccacuuucuuugcucauccauaagga

SEQ ID NO: 1455 - RNA, 119 nt, Homo sapiens
agucagccuguugaagcuuugaagcuuugaugccaggcauugacuucucacuagcugugaaaguccuagcuaaagagaagucaaugcaugacaucuuguuucaauagauggcuguuuca

SEQ ID NO: 1456 - RNA, 117 nt, Homo sapiens
gcccugggcuugugcuuggggagugaaugauggguucugacccccaugcaccccugugggccccuggcaucacuggccccauccuucaccccugccaaccacgcuugcccugugccu

SEQ ID NO: 1457 - RNA, 73 nt, Homo sapiens
cuguggcuuccacgaccuaauccuaacuccugcgagucccuggaguuaggauuaggucguggaagccacagga

SEQ ID NO: 1458 - RNA, 73 nt, Homo sapiens
accuuuccagcucaucccaccucugccaccaaaacacucaucgcggggucagagggagugccaaaaaagguaa

SEQ ID NO: 1459 - RNA, 89 nt, Homo sapiens
ucuccguuuaucccaccacugccaccauuauugcuacuguucagcaggugcugcugguggugauggugauagucuggugggggcggugg

SEQ ID NO: 1460 - RNA, 82 nt, Homo sapiens
ugcuauggauaaggcuuuggcuuauggggauauugugguugaucuguucuauccagaugacugaaacuuucuccauagcagc

SEQ ID NO: 1461 - RNA, 93 nt, Homo sapiens
aucuacaauggugaugggugaauuuguagaaggaugaaagucaaagaauccuucugggaacuaauuuuuggccuucaacaagaauugugauau

SEQ ID NO: 1462 - RNA, 86 nt, Homo sapiens
cuaccccaaaauaugguacccuggcauacugaguauuuuaauacuggcauacucaguaugccauguugccauauuuugggguagca

SEQ ID NO: 1463 - RNA, 69 nt, Homo sapiens
agguccucaauaaguauuuguugaaagaauaaauaaaccaacaagucuuauuugagcaccuguuaugug

SEQ ID NO: 1464 - RNA, 86 nt, Homo sapiens
augguuugggacucaggauguggucaaguguuguuaaggcauguucaggaacaauacuugaccacauuuugaauuccaaaccauau

SEQ ID NO: 1465 - RNA, 84 nt, Homo sapiens
acagguagugucccucagggcuguagaacagggcugggauuacuaaagcccuguucuaugcccugagggacacugagcauguca

SEQ ID NO: 1466 - RNA, 78 nt, Homo sapiens
cucccaaaucuccuguugaaguguaauccccaccuccagcauuggggauuacauuucaacaugagauuuggaugagga

SEQ ID NO: 1467 - RNA, 52 nt, Homo sapiens
uagccgggcgugguggugggggccuguggucccagcuacuuuggaggcugag

SEQ ID NO: 1468 - RNA, 50 nt, Homo sapiens
acccgggcgugguggugggggugggugccuguaauuccagcuaguuggga

SEQ ID NO: 1469 - RNA, 105 nt, Homo sapiens
uggauugccuagaccagggaagccaguuggcauggcucaguccaagucugaccaccugaggaaugccuggacugagccgugcuacuggcuucccuggucuccagc

SEQ ID NO: 1470 - RNA, 75 nt, Homo sapiens
ugagguuucuggacugagccaugcuacuggcuucucugguucuccagcuuacagauggcuuaucaugggaccucu

SEQ ID NO: 1471 - RNA, 83 nt, Homo sapiens
cacagaguuauacuggagauauggaagagcuguguuggguauaaguaacaggcuuuucuuuaucuucuauguggcucuuugca

SEQ ID NO: 1472 - RNA, 83 nt, Homo sapiens; identical to SEQ ID NO: 1471

SEQ ID NO: 1473 - RNA, 86 nt, Homo sapiens
cacccagaucagugcuuggcaccuagcaagcacucaguaaauauuuguugagugccugcuaugugccaggcauugugcugagggcu

SEQ ID NO: 1474 - RNA, 129 nt, Homo sapiens
ccagaucagaucugggugcgaugaugauggcagcaaauucugaaaacgugcucagugucuuuauaacaggaaagccguaaacuuagaaauguaggcugcagcucgugugcucuguggucugggcuggua

SEQ ID NO: 1475 - RNA, 103 nt, Homo sapiens
ugaggcaggagaauugcuugaacccgggugguggagguugcagugagccaagauugcgccacugcacuccagccugggcgacaaagcaagacucuuucuugga

SEQ ID NO: 1476 - RNA, 77 nt, Homo sapiens
ugcagccugggcgacaaaacgagacccugucuuuuuuuuuuucugagacagagucucguucuguugcccaagcugga

SEQ ID NO: 1477 - RNA, 86 nt, Homo sapiens
gaaucgcuugaacccaugagguugaggcugcagugagccaagaucgugccacugcacuucagccugggugacaagagcgaaacuuc

SEQ ID NO: 1478 - RNA, 102 nt, Homo sapiens
ugaggcaggagaauugcuugaacccaggaaguggaggcugcagugagccgagaucgagccacuguacuccagccugggugacacagcgagacuccagucuca

SEQ ID NO: 1479 - RNA, 99 nt, Homo sapiens
aggugggaggauugcuugagccugggagauggagguugcagugagcugagaucacgcaacugcacccccagccugggccauagagucaguccuugucuc

SEQ ID NO: 1480 - RNA, 100 nt, Homo sapiens
gaggugggaggauugcuugagucagggugguugaggcugcaguaaguugugaucauaccacugcacuccagccugagugacagagcaagaccuugucuca

SEQ ID NO: 1481 - RNA, 80 nt, Homo sapiens
ccucugugagaaagggugugggggagaggcugucuugugucuguaaguaugccaaacuuauuuuccccaaggcagaggga

SEQ ID NO: 1482 - RNA, 83 nt, Homo sapiens
ccccagcuagguaaagagcccuguggagacaccuggauucagagaacaugucuccacugagcacuugggccuugauggcggcu

SEQ ID NO: 1483 - RNA, 78 nt, Homo sapiens
accucccaaauauauauauauauguacguauguguauauaaauguauacguagauauauauguauuuuugguggguuu

SEQ ID NO: 1484 - RNA, 81 nt, Homo sapiens
auuugcucauagaugauaugcauaguacucccagaacucauuaaguugguaguacugugcauaucaucuaugagcgaauag

SEQ ID NO: 1485 - RNA, 62 nt, Homo sapiens
auauucacaaaaauucauauugcuucuuucuaaugccaagaaagaagaguauaagaacuucc

SEQ ID NO: 1486 - RNA, 94 nt, Homo sapiens
ucugucccaccgcugccacccuccccucugccucagugugccaggcaucagcacucacucacagaggcaggcuggauggcgggugggacaacag

SEQ ID NO: 1487 - RNA, 54 nt, Homo sapiens
agggggcaccgggaggaggugagugucucuugucgccuccuccucuccccccuu

SEQ ID NO: 1488 - RNA, 101 nt, Homo sapiens
ccuucuucucguuugccuuuuucugcuucugcugcaugaucuccgagucccuggggguagagaugauggggcacugggagguaccagagggcaaaaaggac

SEQ ID NO: 1489 - RNA, 87 nt, Homo sapiens
cucaagcuaugagucuacaaaggaaagcgcuuucuguugucagaaagaagagaaagcgcuucccuuuugaggguuacgguuugagaa

SEQ ID NO: 1490 - RNA, 87 nt, Homo sapiens
cucaagcugugagucuacaaaggaaagcgcuuucuguugucugaaagaaaagaaaucgcuucccuuuggaguguuacgguuugagaa

SEQ ID NO: 1491 - RNA, 120 nt, Homo sapiens
auuuugauauauaagccaguuuaauguuuucuauacagacccuggcuuuucuuaaauuuuauauauuggaaagcccauguuuguauuggaaacugcugguuucuuucauacugaaaaucu

SEQ ID NO: 1492 - RNA, 84 nt, Homo sapiens
uguagagauaggaucucacuuuguugcccaggcuggucucaaacuccuggucugggcaacaaagugagaccuuaucucuacaag

SEQ ID NO: 1493 - RNA, 88 nt, Homo sapiens
uuugggaggccgaggcuggugcaucacuugagcccagcaauuugagaccaaucugggcaacaaagugagaccuccgucucuacaaaga

SEQ ID NO: 1494 - RNA, 78 nt, Homo sapiens
uguccucuggggacucagcuugcucuggcugcuggauugaauuagcugcaggaccaagaugagcccuugguggagaca

SEQ ID NO: 1495 - RNA, 90 nt, Homo sapiens
guugugcuguccaggugcuggaucagugguucgagucugagccuuuaaaagccacucuagccacagaugcagugauuggagccaugacaa

SEQ ID NO: 1496 - RNA, 75 nt, Homo sapiens
gaggguguugaucagcagaucaggacuguaacucaccauagugguggacugcccugaucuggagaccacugccuu

SEQ ID NO: 1497 - RNA, 144 nt, Homo sapiens
uucucaauuuuuaguaggaauuaaaaacaaaacugguaaaugcagacucuugguuuccacccccagagaaucccuaaaccggggguggaguccaggaaucugcauuuuagaaaguacccagggugauucugauaauugggaaca

SEQ ID NO: 1498 - RNA, 111 nt, Homo sapiens
ccacgguccuaguuaaaaaggcacauuccuagacccugccucagaacuacugaacagagucacuggguguggaguccaggaaucugcauuuuuaccccuaucgcccccgcc

SEQ ID NO: 1499 - RNA, 78 nt, Homo sapiens
gagcgucacguugacacucaaaaaguuucagauuuuggaacauuucggauuuuggauuuuuggaucagggaugcucaa

SEQ ID NO: 1500 - RNA, 87 nt, Homo sapiens
gguagaauuccaguggcccugacugaagaccagcaguuguacuguggcuguugguuucaagcagaggccuaaaggacugucuuccug

SEQ ID NO: 1501 - RNA, 66 nt, Homo sapiens
ccugggaacggguuccggcagacgcugagguugcguugacgcucgcgccccggcucccguuccagg

SEQ ID NO: 1502 - RNA, 71 nt, Homo sapiens
agguuguucuggguggucuggagauuugugcagcuuguaccugcacaaaucuccggaccacuuagucuuua

SEQ ID NO: 1503 - RNA, 142 nt, Homo sapiens
caccuaaugugugccaagaucuguucauuuaugaucucaccgaguccugugagguuggcauuguugucuggcauugucugauauacaacagugccaaccucacaggacucagugaggugaaacugaggauuaggaaggugua

SEQ ID NO: 1504 - RNA, 79 nt, Homo sapiens
aggacauuuugcccagauccguggccuauucagaaauguggccugugauuaggccgcagaucugggugaaauguccucc

SEQ ID NO: 1505 - RNA, 60 nt, Homo sapiens
cacccagaucugcggccuaaucacaggccacauuucugaauaggccacggaucugggcaa

SEQ ID NO: 1506 - RNA, 92 nt, Homo sapiens
accuaccuaacuggguuagggcccuggcuccaucuccuuuaggaaaaccuucuguggggaguggggcuucgacccuaacccaggugggcugu

SEQ ID NO: 1507 - RNA, 77 nt, Homo sapiens
uguuuaucucuaggguugaucuauuagaauuacuuaucugagccaaaguaauucaaguaauucagguguagugaaac

SEQ ID NO: 1508 - RNA, 112 nt, Homo sapiens
agacgaggaguuaagaguucauucggcuguccagauguauccaaguacccuguguuauuuggcaauaaauacaucugggcaacugacugaacuuuucacuuuucaugacuca

SEQ ID NO: 1509 - RNA, 83 nt, Homo sapiens
ccucauggcaguguucuggaauccuacgugagggacaaucauucagacccacguagcaguguucuggaauucugugugaggga

SEQ ID NO: 1510 - RNA, 82 nt, Homo sapiens
ggauuguggggggucgcucuaggcaccgcagcacugugcuggggauguugcagcugccugggagugacuucacacaguccuc

SEQ ID NO: 1511 - RNA, 143 nt, Homo sapiens
cagaaagcccaguuaaauuugaauuucaaguaaacaaugaauaauuguguauguaagaauaucccauacaauauuugggacauacuuaugcuaaaaauuauuccuugcuuaucugaaauucaaauguaacuaggauuccugua

SEQ ID NO: 1512 - RNA, 138 nt, Homo sapiens
ggaugcccagcuaguuugaauuuuagauaaacaacgaauaauuucguagcauaaauaugucccaagcuuaguuugggacauacuuaugcuaaaaaacauuauugguuguuuaucugagauucagaauuaagcauuuua

SEQ ID NO: 1513 - RNA, 138 nt, Homo sapiens; identical to SEQ ID NO: 1512

SEQ ID NO: 1514 - RNA, 138 nt, Homo sapiens; identical to SEQ ID NO: 1512

SEQ ID NO: 1515 - RNA, 138 nt, Homo sapiens
ggaugcccagcuaguuugaauuuuagauaaacaacgaauaauuucguagcauaaauauuucccaagcuuaguuugggacauacuuaugcuaaaaaacauuauugguuguuuaucugagauucaaaauuaagcauuuua

SEQ ID NO: 1516 - RNA, 150 nt, Homo sapiens
aaugcagaagcacagcuaaaauuugaauuucagauaaacaaauuuuucuuagaauaaguaugucuccaugcaacauuugggacauacuuaugcuaaaauauuauuuguguuucaucugaaauucaaauucaacuggacauccuguauuuu

SEQ ID NO: 1517 - RNA, 150 nt, Homo sapiens
ugcccggccucccauuaaauugguuuuucagacaaaucacaaauuuguuuagguauaaguauaucccauguaaucuuugggacauacuuaugcuaaaauaauuguuccuuguugauuggaaauuuuaauuuuaauuagguguccuguauu

SEQ ID NO: 1518 - RNA, 90 nt, Homo sapiens
aacaaauaauuugguaauauauguauggcccacacaauauuuaggacaacaauauuugggacauacuuaugcuaaaaaaguauuuguuga

SEQ ID NO: 1519 - RNA, 72 nt, Homo sapiens
acaacauguuuuuaggacauguaugucuggugcaauaauugggacauacuuaugcuaaaaaaauuaguguuc

SEQ ID NO: 1520 - RNA, 128 nt, Homo sapiens
cccauuuaaacuugaauuucauauaaacaccguaauuuucagcauuaguguaucacaugcaguauuugggacauacuuaugcuaaaaaauuaggugguguugaucugaaauuccaguguagaugggca

SEQ ID NO: 1521 - RNA, 138 nt, Homo sapiens; identical to SEQ ID NO: 1512

SEQ ID NO: 1522 - RNA, 86 nt, Homo sapiens
ggcugggcaacauagcgagaccucaacucuacaauuuuuuuuuuuuuaaauuuuagagacggggucuugcucuguugccaggcuuu

SEQ ID NO: 1523 - RNA, 91 nt, Homo sapiens
aaacacuugagcccagcgguuugaggcuacagugagaugugauccugccacaucucacuguagccucgaaccccugggcucaagugauuca

SEQ ID NO: 1524 - RNA, 86 nt, Homo sapiens
aagauccugcuguuucuaccauuaguuuugaauguuuauuguaaagauacuuuucaacucuaaugggagagacagcaggauucucc

SEQ ID NO: 1525 - RNA, 85 nt, Homo sapiens
gugagcagucuccaccaccuccccugcaaacguccaguggugcagagguaauggacguuggcucugguggugauggacaguccga

SEQ ID NO: 1526 - RNA, 149 nt, Homo sapiens
caucaagacccagcugagucacugucacugccuaccaaucucgaccggaccucgaccggcucgucuguguugccaaucgacucggcguggcgucggucgugguagauaggcggucaugcauacgaauuuucagcucuuguucuggugac

SEQ ID NO: 1527 - RNA, 79 nt, Homo sapiens
acauuaugaagcaaguauuauuaucccuguuuuacaaauaaggaaauaaacucagggaggugaaugugaucaaagauag

SEQ ID NO: 1528 - RNA, 71 nt, Homo sapiens
aguaucaugaauuagaaaccuacuuauuacauaguuuacauaagaagcgugaugaugcugcugaugcugua

SEQ ID NO: 1529 - RNA, 73 nt, Homo sapiens
acugagguccucaaaacugaggggcauuuucugugguuugaaaggaaagugcacccaguuuuggggaugucaa

SEQ ID NO: 1530 - RNA, 96 nt, Homo sapiens
ccugaagaggugcaugaagccugguccugcccucacugggaacccccuucccucuggguaccagacagaauucuaugcacuuuccuggaggcucca

SEQ ID NO: 1531 - RNA, 84 nt, Homo sapiens
gcuggcgucggugcuggggagcggcccccgggugggccucugcucuggccccuccuggggcccgcacucucgcucugggcccgc

SEQ ID NO: 1532 - RNA, 86 nt, Homo sapiens
ggugggugguuucuccguuugccuguuucgcugaugugcauucaacucauucucagcaaaauaagcaaauggaaaauucguccauc

SEQ ID NO: 1533 - RNA, 47 nt, Homo sapiens
cucggcgcggggcgcgggcuccggguuggggcgagccaacgccgggg

SEQ ID NO: 1534 - RNA, 61 nt, Homo sapiens
gcccuccgcccgugcaccccggggcaggagaccccgcgggacgcgccgagguaggggggac

SEQ ID NO: 1535 - RNA, 57 nt, Homo sapiens
gcccgcguguggagccagguguagaggcggagcacagcuggcucuaauuugaggggc

SEQ ID NO: 1536 - RNA, 61 nt, Homo sapiens
acagcuguaauuagucaguuuucuguccuguccacacagaaaaccgucuaguuacaguugu

SEQ ID NO: 1537 - RNA, 61 nt, Homo sapiens
gggaacagcagcaacaugggccucgcuuccugccggcgcggcccgggcugcugcuguuccu

SEQ ID NO: 1538 - RNA, 50 nt, Homo sapiens
ggcucugcggccugcagguagcgcgaaaguccugcgcgucccagaugccc

SEQ ID NO: 1539 - RNA, 53 nt, Homo sapiens
uuugggcugggcuggguugggcaguucuucugcuggacucaccugugaccagc

SEQ ID NO: 1540 - RNA, 53 nt, Homo sapiens
agagacuggggugcugggcuccccuagacuaggacuccagugcccuccucucc

SEQ ID NO: 1541 - RNA, 66 nt, Homo sapiens
ucagcagcacagccuucagccuaaagcaaugagaagccucugaaaggcugaggcaguagauugaau

SEQ ID NO: 1542 - RNA, 80 nt, Homo sapiens
cgggaaugccgcggcggggacggcgauugguccguauguguggugccaccggccgccggcuccgccccggcccccgcccc

SEQ ID NO: 1543 - RNA, 80 nt, Homo sapiens
cauccaggacaauggugagugccggugccugcccuggggccgucccugcgcaggggccgggugcucaccgcaucugcccc

SEQ ID NO: 1544 - RNA, 80 nt, Homo sapiens
ugucccuucagccaguccugugccugccgccuuugugcuguccuuggagggaggcagaagcaggaugacaaugagggcaa

SEQ ID NO: 1545 - RNA, 80 nt, Homo sapiens
ucggcaucugcugaguaccgccaugucuguugggcauccacagucucccaccaggcauuguggucuccgcugacgcuuug

SEQ ID NO: 1546 - RNA, 80 nt, Homo sapiens
cucuaggaugugcucauugcaugggcuguguauaguauuauucaauacccagagcaugcagugugaacauaauagagauu

SEQ ID NO: 1547 - RNA, 80 nt, Homo sapiens
accucuaccucccggcagaggaggcugcagaggcuggcuuuccaaaacucugcccccuccgcugcugccaaguggcuggu

SEQ ID NO: 1548 - RNA, 80 nt, Homo sapiens
cgugugagcccgcccugugcccggcccacuucugcuuccucuuagcgcaggaggggucccgcacugggaggggcccucac

SEQ ID NO: 1549 - RNA, 80 nt, Homo sapiens
ugagaggccgcaccuugccuugcugcccgggccgugcacccgugggccccagggcgacgcggcgggggcggcccuagcga

SEQ ID NO: 1550 - RNA, 77 nt, Homo sapiens
uauaggcaugugccaccacaccuggcuuaaaugugucauuuaaaaauucaggccaggcacaguggcucaugccugua

SEQ ID NO: 1551 - RNA, 77 nt, Homo sapiens; identical to SEQ ID NO: 1550

SEQ ID NO: 1552 - RNA, 44 nt, Homo sapiens
uauguucaacggccaugguauccugaccgugcaaagguagcaua

SEQ ID NO: 1553 - RNA, 52 nt, Homo sapiens
gcagcaaggaaggcagggguccuaagguguguccuccugcccuccuugcugu

SEQ ID NO: 1554 - RNA, 55 nt, Homo sapiens
cuguuuugauaacaguaaugucccuuuaguucaaaguuaccagcuaucaaaacaa

SEQ ID NO: 1555 - RNA, 91 nt, Homo sapiens
cuugccauguaaauacagauuuaauuaacauuugcaaccugugaagaugcaaaacuuuaaguguuaauuaaaccucuauuuacauagcaag

SEQ ID NO: 1556 - RNA, 49 nt, Homo sapiens
cuguaauauaaauuuaauuuauucucuaucauuaaaaaauguauuacag

SEQ ID NO: 1557 - RNA, 75 nt, Homo sapiens
cagggguuuggggaaacggccgcugagugaggcgucggcuguguuucucaccgcggucuuuuccucccacucuug

SEQ ID NO: 1558 - RNA, 91 nt, Homo sapiens
uuuucaaagcaaugugugacagguacagggacaaaucccguuaauaaguaagaggauuugugcuuggcucugucacaugccacuuugaaaa

SEQ ID NO: 1559 - RNA, 80 nt, Homo sapiens
ccuccaugcuccuagucccuuccuugaagcggucggauaaucacaugacgagccucaagcaagggacuucaagcuggugg

SEQ ID NO: 1560 - RNA, 100 nt, Homo sapiens
acugucaucccacugcuuccagcuuccaugacuccugauggaggaaucacaugaauucaucagaauucauggaggcuagaagcaguaugaggaucauuua

SEQ ID NO: 1561 - RNA, 80 nt, Homo sapiens
gaccuaggcuagggguucuuagcauaggaggucuucccaugcuaagaaguccucccaugccaagaacucccagacuagga

SEQ ID NO: 1562 - RNA, 80 nt, Homo sapiens
gcucugauuuacuucuguccggcauggugaacagcaggauuggcuguagcuguucucuuugccaaggacagaucugaucu

SEQ ID NO: 1563 - RNA, 89 nt, Homo sapiens
guguucuuccaguccgcccucugucaccuugcagacggcuuucucuccgaaugucugcaagugucagaggcgaggaguggcagcugcau

SEQ ID NO: 1564 - RNA, 93 nt, Homo sapiens
gugcuuccugcgggcugagcgcgggcugagcgcugccagucagcgcucacauuaaggcugacagcgcccugccuggcucggccggcgaagcuc

SEQ ID NO: 1565 - RNA, 96 nt, Homo sapiens
gugcugcagguguuggagagcaguguguguugccuggggacuguguggacugguaucacccagacagcuugcacugacuccagacccugccgucau

SEQ ID NO: 1566 - RNA, 87 nt, Homo sapiens
cagacgugucauccccagauacaauggacaauaugcuauuauaaucguauggcauuguccuugcuguuuggagauaauacugcugac

SEQ ID NO: 1567 - RNA, 84 nt, Homo sapiens
auggucccucccaauccagccauuccucagaccagguggcucccgagccaccccaggcuguaggaugggggugagaggugcuag

SEQ ID NO: 1568 - RNA, 81 nt, Homo sapiens
ggacaggcaccugaggcucuguuagccuuggcucuggguccugcuccuuagagcagaggcagagaggcucagggucugucu

SEQ ID NO: 1569 - RNA, 105 nt, Homo sapiens
gcccccuuuucacgcauuuguguuuuaccaccuccaggagacugcccaaagacucuucaguaucauggaguugguaaagcacagaugcaugaauaauucaacgug

SEQ ID NO: 1570 - RNA, 110 nt, Homo sapiens
accuuccugaaagagguuggggcaggcagugacuguucagacguccaaucucuuugggacgccucuucagcgcugucuucccugccucugccuuuaggacgagucucaaa

SEQ ID NO: 1571 - RNA, 90 nt, Homo sapiens
ggcgccucugcagcuccggcucccccuggccucucgggaacuacaagucccagggggccuggcggugggcggcgggcggaagaggcgggg

SEQ ID NO: 1572 - RNA, 69 nt, Homo sapiens
gguguuagggccaacaucucuuggucuuuccccuguggucccaagauggcuguugcaacuuaacgccau

SEQ ID NO: 1573 - RNA, 88 nt, Homo sapiens
ggagcucagccacagauguccagccacaauucucgguuggccgcagacucguacaagaauugcguuuggacaaucaguggcgaagccc

SEQ ID NO: 1574 - RNA, 66 nt, Homo sapiens
ggucuggcuguuguggugugcaaaacuccguacauugcuauuuugccacacugcaacaccuuacag

SEQ ID NO: 1575 - RNA, 79 nt, Homo sapiens
cugcccucuucaacaaaaucacugaugcuggagucgccugagucaucacucagcaccaggauauuguuggagaggacag

SEQ ID NO: 1576 - RNA, 81 nt, Homo sapiens
gcucgacuccuguuccugcugaacugagccaguguguaaaaugagaacugauaucagcucaguaggcaccggagggcgggu

SEQ ID NO: 1577 - RNA, 68 nt, Homo sapiens
ucugaauauggguuuacuaguugguggugaauucaugagucgccaacuauuaggccuuuauguccaga

SEQ ID NO: 1578 - RNA, 74 nt, Homo sapiens
cuuuauugagucccuacuauguuccaggcacuggguaucguaggugccuggaacauaguagggacucaauaaag

SEQ ID NO: 1579 - RNA, 68 nt, Homo sapiens
uauugagucccuacuauguuccaggcaccuacgauacccagugccuggaacauaguagggacucaaua

SEQ ID NO: 1580 - RNA, 78 nt, Homo sapiens
cccuaaagggccagacacuauacgagucauauaagggaaggcauuauaggacucauauagugccagguguuuuguggg

SEQ ID NO: 1581 - RNA, 75 nt, Homo sapiens
cacacuacaauaauuuucauaaugcaaucacacauaaucacuaugugacugcauuaugaaaauucuuguagugug

SEQ ID NO: 1582 - RNA, 73 nt, Homo sapiens
acacuacaauaauuuucauaaugcaaucacacauaaucacuaugugacugcauuaugaaaauucuuguagugu

SEQ ID NO: 1583 - RNA, 75 nt, Homo sapiens; identical to SEQ ID NO: 1581

SEQ ID NO: 1584 - RNA, 75 nt, Homo sapiens
cauacuacaauaauuuucauaaugcaaucacacacaaucaccgugugacugcauuaugaaaauucuucuagugug

SEQ ID NO: 1585 - RNA, 76 nt, Homo sapiens
cacacauacaauaauauucauaaugcaaucacacacaaucaccaugugacugcauuaugaaaauucuucuagugug

SEQ ID NO: 1586 - RNA, 75 nt, Homo sapiens; identical to SEQ ID NO: 1584

SEQ ID NO: 1587 - RNA, 85 nt, Homo sapiens
auuaacucuggcuuuuaacuuugauggcaaagggguagcuaaacaaucuaugucuuugccaucaaaguuaaaagccauaguuaau

SEQ ID NO: 1588 - RNA, 85 nt, Homo sapiens
auuaacuauggcuuuuaacuuugauggcaaagacauagauuguuuagcuaccccuuugccaucaaaguuaaaagccagaguuaau

SEQ ID NO: 1589 - RNA, 81 nt, Homo sapiens
gucaugugacugccugucugugccugcuguacaggugagcggauguucugcacagcaaguguagacaggcagacacaugac

SEQ ID NO: 1590 - RNA, 77 nt, Homo sapiens
aaaugguuauguccuuugccuauucuauuuaagacacccuguaccuuaaauagaguaggcaaaggacagaaacauuu

SEQ ID NO: 1591 - RNA, 73 nt, Homo sapiens
accagcucuguugggacaagaggacggucuucuuuuggaaggaagaccaucaucuuguccgaagagagcuggu

SEQ ID NO: 1592 - RNA, 75 nt, Homo sapiens
auggauuugauugaaugauucucccauuuccacauggagaguggagcccagagaauuguuuaaucauguauccau

SEQ ID NO: 1593 - RNA, 67 nt, Homo sapiens
gcgggcuucgcgggcgaaggcaaagucgauuuccaaaagugacuuuccucacucccgugaagucggc

SEQ ID NO: 1594 - RNA, 78 nt, Homo sapiens
gagaauggguagaggaagcuguggagagaacucacggugccugugguucgagauccccgccuuccuccuccuuuccuc

SEQ ID NO: 1595 - RNA, 74 nt, Homo sapiens
augauuauaugagggacagaugccagaagcacugguuaugauuugcaucuggcauccgucacacagauaauuau

SEQ ID NO: 1596 - RNA, 76 nt, Homo sapiens
ggccaggcccaucagggcuuguggaaugggaaggagaagggacgcuuccccuucugcaggccugcuggguguggcu

SEQ ID NO: 1597 - RNA, 66 nt, Homo sapiens
uuccucuggcaaguaaaaaacucucauuuuccuuaaaaaaugagaguuuuuuacuugcaauaggaa

SEQ ID NO: 1598 - RNA, 76 nt, Homo sapiens
guacuugggcaguaguguagagauugguuugccuguuaaugaauucaaacuaaucucuacacugcugcccaagagc

SEQ ID NO: 1599 - RNA, 75 nt, Homo sapiens
cuugucaugucuuacccagucuccggugcagccuguugucaaggcugcaccggagacuggguaagacaugacaag

SEQ ID NO: 1600 - RNA, 75 nt, Homo sapiens
cuugucaugucuuacccagucuccggugcagccuugacaacaggcugcaccggagacuggguaagacaugacaag

SEQ ID NO: 1601 - RNA, 63 nt, Homo sapiens
gagucgaggacugguggaagggccuuuccccucagaccaaggcccuggccccagcuucuucuc

SEQ ID NO: 1602 - RNA, 75 nt, Homo sapiens
ggugggauggguagagaaggagcucagaggacggugcgccuuguuucccuugagcccucccucucucaucccacc

SEQ ID NO: 1603 - RNA, 78 nt, Homo sapiens
cagaaauuguaaagaacucuuaaaacccaauaguaaaaagacaaccuguugaguuuuaagaguucuuuauauauucug

SEQ ID NO: 1604 - RNA, 74 nt, Homo sapiens
uguauccaauguguagucuuuuaucccucacauggaguaaaauaugauggauaaaagacuacauauuggguaca

SEQ ID NO: 1605 - RNA, 77 nt, Homo sapiens
ucacuuuggugccuaggcugagacugcaguggugcaaucucaguucacugcagccuugaccuccugggcucagguga

SEQ ID NO: 1606 - RNA, 68 nt, Homo sapiens
ugcccaggcuggagcgagugcaguggugcagucaguccuagcucacugcagccucgaacuccugggcu

SEQ ID NO: 1607 - RNA, 78 nt, Homo sapiens
aauaugaaacugacugaauagguagggucauuuuucugugacugcacauggcccaaccuauucaguuaguuccauauu

SEQ ID NO: 1608 - RNA, 75 nt, Homo sapiens
uacaggucuguagccugggagcaaugggguguaugguauagggguagccucgugcuccugggcuacaaaccugua

SEQ ID NO: 1609 - RNA, 82 nt, Homo sapiens
cccuccucggcacuucccccaccucacugcccgggugcccacaagacuguggacagugagguagagggagugccgaggaggg

SEQ ID NO: 1610 - RNA, 76 nt, Homo sapiens
ggcucagaguaggagcucaacagaugccuguugacugaauaauaaacagguaucgcaggagcuuuuguuaugugcc

SEQ ID NO: 1611 - RNA, 90 nt, Homo sapiens
ccucuugagguaccugaauuaccaaaagcuuuauguauucugaaguuauugaaaauaagagcuuuugggaauucagguaguucaggagug

SEQ ID NO: 1612 - RNA, 61 nt, Homo sapiens
ucacccggugagggcggguggaggaggaggguccccaccaucagccuucacugggacggga

SEQ ID NO: 1613 - RNA, 82 nt, Homo sapiens
uucagaaaggccuuucugaaccuucagaaaggcugcugaaucuucagaaaggccuuucugaaccuucagaaaggcugcugaa

SEQ ID NO: 1614 - RNA, 63 nt, Homo sapiens
uagauaacauuguaaagcgcuucuuucgcgguugggcuggagcaacucuuuacaauguuucua

SEQ ID NO: 1615 - RNA, 79 nt, Homo sapiens
aacuacacuuuaaggggaccaaagagauauauagauaucagcuaccuauauaccuguucggucucuuuaaaguguaguu

SEQ ID NO: 1616 - RNA, 82 nt, Homo sapiens
uauaugaguucaacuccaaacacucaaaacucauuguugaauggaaugagauauuuugaguguuuggaauugaacucguaua

SEQ ID NO: 1617 - RNA, 79 nt, Homo sapiens
gcuaagucccuucuuucuauccuaguauaacuugaagaauucaaauagucaugcuaggauagaaagaaugggacuuggc

SEQ ID NO: 1618 - RNA, 66 nt, Homo sapiens
guccggguugggcagugaggagggugugacgccgcgaagugcaccucgcccuuguccaacucggac

SEQ ID NO: 1619 - RNA, 77 nt, Homo sapiens
gaguuaagauggaaaaaacuggugugugcuuauugauguagccaacaagcauacaucaguuuuuuccaacuuaacuc

SEQ ID NO: 1620 - RNA, 83 nt, Homo sapiens
auacauacauguacacacacaugucauccacacacauacauauauauauguuuguauggauauguguguguauguguguguau

SEQ ID NO: 1621 - RNA, 80 nt, Homo sapiens
gggaagcaggccaaccucgacgaucuccucagcaccugaacgccaaggcuggggagauccucgagguuggccugcuuucc

SEQ ID NO: 1622 - RNA, 86 nt, Homo sapiens
gagggaaagcaggccaaccucgaggaucuccccagccuuggcguucaggugcugaggagaucgucgagguuggccugcuuccccuc

SEQ ID NO: 1623 - RNA, 76 nt, Homo sapiens
ggggugauggguggggcaaugggaucaggugccucaaagggcaucccaccugaucccacagcccaccugucacccc

SEQ ID NO: 1624 - RNA, 74 nt, Homo sapiens
gugcagaguuauugccucuguucuaacacaagacuaggcuucccuguguuagaauaggggcaauaacucugcac

SEQ ID NO: 1625 - RNA, 82 nt, Homo sapiens
gacaaauuuuaaaugucccuguccccuuccccccaauuaaaguagauugggggaaagcgaguagggacauuuaaaauuuguu

SEQ ID NO: 1626 - RNA, 84 nt, Homo sapiens
ggccccuccuucucagccccagcucccgcucaccccugccacgucaaaggaggcagaaggggaguugggagcagagaggggacc

SEQ ID NO: 1627 - RNA, 82 nt, Homo sapiens
uccgggcaucaccucccacugcagagccuggggagccggacagcucccuucccaggcucugcagugggaacugaugccugga

SEQ ID NO: 1628 - RNA, 56 nt, Homo sapiens
ccacugcagagccugggaagggagcuguccggcuccccaggcucugcagugggagu

SEQ ID NO: 1629 - RNA, 75 nt, Homo sapiens
gcagaagaaagaucuggaagugggagacacuuuuacuauauauaguggcucccacuuccagaucuuucucucugu

SEQ ID NO: 1630 - RNA, 77 nt, Homo sapiens
ugcagaagaaagaucuggaagugggagacacuuucacuauauauaguggcucccacuuccagaucuuucucucugua

SEQ ID NO: 1631 - RNA, 77 nt, Homo sapiens
ugcagaagaaagaucuggaagugggagacacuuucacuauauauaguggcucccacuuccugaucuuucucucugua

SEQ ID NO: 1632 - RNA, 85 nt, Homo sapiens
gggaagggcuucagccaggcuagugcagucugcuuugugccaacacuggggugaugacugcccuagucuagcugaagcuuuuccc

SEQ ID NO: 1633 - RNA, 81 nt, Homo sapiens
auucaggccgguccugcagagaggaagcccuucugcuuacagguauuggaagggcuuccucucugcaggaccggccugaau

SEQ ID NO: 1634 - RNA, 81 nt, Homo sapiens
auucaggccgguccugcagagaggaagcccuuccaauaccuguaagcagaagggcuuccucucugcaggaccggccugaau

SEQ ID NO: 1635 - RNA, 74 nt, Homo sapiens
ccaaaguccuaggauuacaagugucggccacgggcugggcacaguggcucacgccuguaaucccagcauuuugg

SEQ ID NO: 1636 - RNA, 85 nt, Homo sapiens
ggaccugcccugggcuuucuagucucagcucuccuccagcucagcuggucaggagagcugagacuagaaagcccagggcagguuc

SEQ ID NO: 1637 - RNA, 81 nt, Homo sapiens
accugcccugggcuuucuagucucagcucuccugaccagcugagcuggaggagagcugagacuagaaagcccagggcaggu

SEQ ID NO: 1638 - RNA, 77 nt, Homo sapiens
ccucgagagcugauaagaacagaggcccagauugaaguugaauagugcugggccuuuguuuuuaccaaguucccugg

SEQ ID NO: 1639 - RNA, 82 nt, Homo sapiens
cugacuuuuuuagggaguagaaggguggggagcaugaacaauguuucucacucccuaccccuccacuccccaaaaaagucag

SEQ ID NO: 1640 - RNA, 73 nt, Homo sapiens
uuccucaucuauaaaaugagggcaguaagaccuuccuuccuugucuuacuacccccauuuuauagaugaggaa

SEQ ID NO: 1641 - RNA, 83 nt, Homo sapiens
cuuggaaacugugacuuuaagggaaauggcgcacagcagacccugcaaucaugccguuuugcuugaagucgcaguuucccagg

SEQ ID NO: 1642 - RNA, 75 nt, Homo sapiens
ccgguggcaagguggaugcaaugugaccucaacucuugguccucugaggucacauuguauccaccuuaccacugg

SEQ ID NO: 1643 - RNA, 92 nt, Homo sapiens
aaauuuuuuugaggccaguaggcauugucugcguuaggauuucuguaucauccuccuaacgcagacaaugccuacuggccuaagaaaaauuu

SEQ ID NO: 1644 - RNA, 85 nt, Homo sapiens
ggcuguggaggcaccaguauuucugaaauucuuuuuucugaaauucuucaggaaggauuucagaaauacuggugucccgacagcc

SEQ ID NO: 1645 - RNA, 82 nt, Homo sapiens
aagaucaugaguucuacagucagacagccugaguuggaggcucaucuucacuucuugcugugugacccugggccagugacuu

SEQ ID NO: 1646 - RNA, 83 nt, Homo sapiens
augugaaaacauaggacugugcuuggcacauagcacaaagucuuaugguacugugugccaagcauaguccuguguuuuuacau

SEQ ID NO: 1647 - RNA, 77 nt, Homo sapiens
cugguaacacugggguucugagacagacaguguuagcuccagaagcauugccugucuuagaaccccuauguuaccag

SEQ ID NO: 1648 - RNA, 74 nt, Homo sapiens
uauauauagagauguauggaaucuguauauaucuauauauauguguauauauagauuccauaaaucuauauaug

SEQ ID NO: 1649 - RNA, 68 nt, Homo sapiens
ucccugcccugccuguuuucuccuuugugauuuuaugagaacaaaggaggaaauaggcaggccaggga

SEQ ID NO: 1650 - RNA, 87 nt, Homo sapiens
guuaccugguagugaguuagagaugcagagcccugggcuccucagcaaaccuacuggaucugcauuuuaauucacaugcaugguaau

SEQ ID NO: 1651 - RNA, 77 nt, Homo sapiens
ccuggggggcggggagagaacgcagugacgucuggccgcgugcgcaugucgggcgcuuucuccucccccuacccagg

SEQ ID NO: 1652 - RNA, 90 nt, Homo sapiens
uggccucuccagucugcagcucccggcagccucgggccacacucccgggauccccagggacuggccugggacuaccggggguggcggccg

SEQ ID NO: 1653 - RNA, 82 nt, Homo sapiens
ccacgugccauguguacacacgugccaggcgcugucuugagacauucgcgcagugcacggcacuggggacacguggcacugg

SEQ ID NO: 1654 - RNA, 84 nt, Homo sapiens
gaggcugggcggggcgcggccggaucggucgagagcguccuggcugaugacggucucccgugcccacgccccaaacgcagucuc

SEQ ID NO: 1655 - RNA, 84 nt, Homo sapiens
caggaucacagacguuuaaauuacacuccuucugcugugccuuacagcaguagaaggggugaaauuuaaacgucugugauccug

SEQ ID NO: 1656 - RNA, 84 nt, Homo sapiens; identical to SEQ ID NO: 1655

SEQ ID NO: 1657 - RNA, 84 nt, Homo sapiens; identical to SEQ ID NO: 1655

SEQ ID NO: 1658 - RNA, 94 nt, Homo sapiens
cagugcgacgggcggagcuuccagacgcuccgccccacgucgcaugcgccccgggaaagcguggggcggagcuuccggaggccccgcccugcug

SEQ ID NO: 1659 - RNA, 88 nt, Homo sapiens
gcgacgggcggagcuuccagacgcuccgccccacgucgcaugcgccccgggaaagcguggggcggagcuuccggaggccccgcccugc

SEQ ID NO: 1660 - RNA, 94 nt, Homo sapiens; identical to SEQ ID NO: 1658

SEQ ID NO: 1661 - RNA, 153 nt, Homo sapiens
gcuccgccccacgucgcaugcgccccgggaacgcguggggcggagcuuccggaggccccgcucugcugccgacccuguggagcggagggugaagccuccggaugccagucccucaucgcuggccuggucgcgcuguggcgaagggggcggagc

SEQ ID NO: 1662 - RNA, 153 nt, Homo sapiens
gcuccgccccacgucgcaugcgccccgggaacgcguggggcggagcuuccggaggccccgcccugcugccgacccuguggagcggagggugaagccuccggaugccagucccucaucgcuggcccggucgcgcuguggcgaagggggcggagc

SEQ ID NO: 1663 - RNA, 73 nt, Homo sapiens
cggcgaccaucgggcccucggcgccggcccguuaguugcccgggcccgagccggccgggcccgcggguugccg

SEQ ID NO: 1664 - RNA, 63 nt, Homo sapiens
gcugcuucuguaguguaguccgugcauccgcccuucgaugcuuggguuggaucauagagcagu

SEQ ID NO: 1665 - RNA, 84 nt, Homo sapiens
cucugcccugccucucucggagucgcucggagcagucacguugacggaauccuccggcgccuccucgagggaggagaggcaggg

SEQ ID NO: 1666 - RNA, 75 nt, Homo sapiens
aagcaagacugaggggccucagaccgagcuuuuggaaaauagaaaagucucgcucucugccccucagccuaacuu

SEQ ID NO: 1667 - RNA, 68 nt, Homo sapiens
gaauggaagaagaaggcggucggucugcgggagccaggccgcagagccauccgccuucuguccauguc

SEQ ID NO: 1668 - RNA, 85 nt, Homo sapiens
agccugcgguuccaacaggcgucugucuacguggcuucaaccaaguucaaagucacgcggagagauggcuuuggaaccaggggcu

SEQ ID NO: 1669 - RNA, 70 nt, Homo sapiens
gcuggcccugggcagcguguggcugaaggucaccauguucuccuuggccauggggcugcgcggggccagc

SEQ ID NO: 1670 - RNA, 85 nt, Homo sapiens
ggcgccuccugcucugcugugccgccagggccuccccuagcgcgccuucuggagaggcuuugugcggauacggggcuggaggccu

SEQ ID NO: 1671 - RNA, 73 nt, Homo sapiens
gccucaguugccccaucugugcccuggguaggaauauccuggauccccuugggucugaugggguagccgaugc

SEQ ID NO: 1672 - RNA, 80 nt, Homo sapiens
cuggggucaccugucuggccagcuacguccccacggcccuugucaguguggaagguagacggccagagaggugaccccgg

SEQ ID NO: 1673 - RNA, 76 nt, Homo sapiens
ggggucaccucucuggccgucuaccuuccacacugacaagggccguggggacguagcuggccagacaggugacccc

SEQ ID NO: 1674 - RNA, 77 nt, Homo sapiens
ggaagggauucugggagguuguagcaguggaaaaaguucuuuucuuccucugaucgcccucucagcucuuuccuucu

SEQ ID NO: 1675 - RNA, 55 nt, Homo sapiens
uccugcguaggaucugaggaguggacgagucucauuacccagcuccugagcagga

SEQ ID NO: 1676 - RNA, 73 nt, Homo sapiens
agguggcagggccagccaccaggagggcugcgugccacccgggcagcucugcugcucacuggcagugucaccu

SEQ ID NO: 1677 - RNA, 84 nt, Homo sapiens
ccgcagccgccgcgccgggcccggguuggccgcugacccccgcggggcccccggcggccggggcgggggcgggggcugccccgg

SEQ ID NO: 1678 - RNA, 64 nt, Homo sapiens
gggugggggcggggcggcaggggccucccccagugccaggccccauucugcuucucucccagcu

SEQ ID NO: 1679 - RNA, 73 nt, Homo sapiens
ggcgaggggaggcgcaggcucggaaaggcgcgcgaggcuccaggcuccuucccgauccaccgcucuccucgcu

SEQ ID NO: 1680 - RNA, 80 nt, Homo sapiens
gacugugcucucacuguucacccagcacuagcaguaccagacgguucuguggaguccuggggaauggagagagcacaguc

SEQ ID NO: 1681 - RNA, 80 nt, Homo sapiens
gacucugcucucacuguucacccagcacuagcaguaccagaugguucuguggaguccuggggaauggagagagcacaguc

SEQ ID NO: 1682 - RNA, 88 nt, Homo sapiens
ggugacuccagggacugccuuaggagaaaguuucuggaaguucugacauuccagaaacuuucuccuaaggcagucccugggagucacu

SEQ ID NO: 1683 - RNA, 86 nt, Homo sapiens
gugacucccagggacugccuuaggagaaaguuucuggaaugucagaacuuccagaaacuuucuccuaaggcagucccuggagucac

SEQ ID NO: 1684 - RNA, 85 nt, Homo sapiens
gguggucgagggaaucugagaaggcgcacaagguuuguguccaauacaguccacaccuugcgcuacucaggucugcucgugcccu

SEQ ID NO: 1685 - RNA, 52 nt, Homo sapiens
gggauaugaagaaaaauaagaggcuaggauugccucuuauuuuuacaugccc

SEQ ID NO: 1686 - RNA, 81 nt, Homo sapiens
uauuaauauggaagggagaagagcuuuaaugauuggagucauuuucagagcauuaaagcucuucucccuuccauauuaaug

SEQ ID NO: 1687 - RNA, 79 nt, Homo sapiens
auuaauauggaagggagaagagcuuuaaugcucugaaaaugacuccaaucauuaaagcucuucucccuuccauauuaau

SEQ ID NO: 1688 - RNA, 78 nt, Homo sapiens
ggcaccauuagguagacugggauuuguuguugagcgcaguaagacaacaacaaaaucacuagucuuccagauggggcc

SEQ ID NO: 1689 - RNA, 86 nt, Homo sapiens
gcgcccgccgggucuagugguccuaaacauuucacaauugcgcuacagaacuguugaacuguuaagaaccacuggacccagcgcgc

SEQ ID NO: 1690 - RNA, 73 nt, Homo sapiens
caguagcuauuuagugugauaauggcguuugauaguuuagacacaaacaccauugucacacuccacagcucug

SEQ ID NO: 1691 - RNA, 100 nt, Homo sapiens
acuuuauacguguaauugugaugaggauggauagcaaggaagccgcucccaccugacccucacggccuccguguuaccuguccucuaggugggacgcucg

SEQ ID NO: 1692 - RNA, 63 nt, Homo sapiens
uuguugcuaucuagguuagugaaggcuauuuuaauuuuuuuaaaauuucuuucacuacuuagg

SEQ ID NO: 1693 - RNA, 79 nt, Homo sapiens
aagguugcggugcaugugaugaagcaaaucaguaugaaugaauucaugauacuguaaacgcuuucugauguacuacuca

SEQ ID NO: 1694 - RNA, 80 nt, Homo sapiens
guaacaguaacuuuuauucucauuuuccuuuucucuaccuuguagagaagcaaagugaugaguaauacuggcuggagccc

SEQ ID NO: 1695 - RNA, 73 nt, Homo sapiens
aagagccgcggcguaacggcagccaucuuguuuguuugagugaaucggaaaggaggcgccggcuguggcggcg

SEQ ID NO: 1696 - RNA, 83 nt, Homo sapiens
agcaggucuaauaagaauuucuuuuucuucacaauuaugaaagaaaagaaauugugaagaaagaaauucuuacuaguuuugcu

SEQ ID NO: 1697 - RNA, 87 nt, Homo sapiens
gggacuggggaugaggaggcaucuugagaaauggaaggaaugggaucuacuuccaguucacuagaggcguccugacaccccuagcuc

SEQ ID NO: 1698 - RNA, 87 nt, Homo sapiens
ugguuggguuuggauuguuguacuuuuuuuuuuguucguugcauuuuuaggaacaaaaaaaaaagcccaacccuucacaccacuuca

SEQ ID NO: 1699 - RNA, 86 nt, Homo sapiens
gguucugucuugggccacuuggaucugaaggcugccccuuugcucucugggguagccuucagaucuugguguuuugaauucuuacu

SEQ ID NO: 1700 - RNA, 87 nt, Homo sapiens
gacucugggacgcucagacgccgcgcggggcggggauuggucugugguccucucucggcuccucgcggcucgcggcggccgacgguu

SEQ ID NO: 1701 - RNA, 92 nt, Homo sapiens
ugucacuccgccagcaucaugaagugcacucaugauauguuugccccaucagcgugucacgagggcauuucaugaugcaggcgggguuggca

SEQ ID NO: 1702 - RNA, 79 nt, Homo sapiens
aggucauagaaagacauaguugcaagaugggauuagaaaccauaugucucaucagcacccuauguccuuucucugcccu

SEQ ID NO: 1703 - RNA, 88 nt, Homo sapiens
uaagcugagugcauugugauuuccaauaauugaggcagugguucuaaaagcugucuacauuaaugaaaagagcaauguggccagcuug

SEQ ID NO: 1704 - RNA, 83 nt, Homo sapiens
acggcaucuuugcacucagcaggcaggcuggugcagcccguggugggggaccauccugccugcugugggguaaggacggcugu

SEQ ID NO: 1705 - RNA, 79 nt, Homo sapiens
gugaggugggggccagcagggagugggcugggcugggcugggccaagguacaaggccucacccugcaucccgcacccag

SEQ ID NO: 1706 - RNA, 85 nt, Homo sapiens
gugagcugcuggggacgcgggucggggucugcagggcggugcggcagccgccaccugacgccgcgccuuugucugugucccacag

SEQ ID NO: 1707 - RNA, 83 nt, Homo sapiens
aauagagggugcacaggcacgggagcucaggugaggcagggagcugagcucaccugaccucccaugccugugcacccucuauu

SEQ ID NO: 1708 - RNA, 95 nt, Homo sapiens
agugauauaauagagggugcacaggcaugggaggucaggugagcucagcucccugccucaccugagcucccgugccugugcacccucuauuggcu

SEQ ID NO: 1709 - RNA, 84 nt, Homo sapiens
uucaguagguuggguucauuucauuuucaugacaacccuauaugggaaaauguugugaaaaugaaaugagcccagcccauugaa

SEQ ID NO: 1710 - RNA, 180 nt, Homo sapiens
cgcgacugcggcggcggugguggggggagccgcggggaucgccgagggccggucggccgccccgggugccgcgcggugccgccggcggcggugaggccccgcgcgugugucccggcugcggucggccgcgcucgagggguccccguggcguccccuuccccgccggccgccuuucucgcg

SEQ ID NO: 1711 - RNA, 66 nt, Homo sapiens
gcuuggaacaggcaccugugugugcccaaguguuucuagcaaacacagggaccugagugucuaagc

SEQ ID NO: 1712 - RNA, 60 nt, Homo sapiens
ucaaggugugucuguagaguccugacugcgugccaggggcucugucuggcacauuucuga

SEQ ID NO: 1713 - RNA, 90 nt, Homo sapiens
gauucgaugggccauagcaauccugugauuuaugcauggaggcugcuucuccucagcagcugccauagcccggucgcugguacaugauuc

SEQ ID NO: 1714 - RNA, 131 nt, Homo sapiens
cggcuggaggugugaggauccgaacccaggggugggggguggaggcggcuccugcgaucgaaggggacuugagacucaccggccgcacgccaugagggcccugugggugcugggccucugcugcguccugc

SEQ ID NO: 1715 - RNA, 110 nt, Homo sapiens
ucccuggggaccccuggcagccccuccugaugauucuucuuccugagcacgcucaugaugagcaaacugagccucuaagaaguugacugaaggggcugcuuccccaagga

SEQ ID NO: 1716 - RNA, 56 nt, Homo sapiens
uucaugagcugcaaucucaucacuggaauguuccagcgacuggacaagcugaggaa

SEQ ID NO: 1717 - RNA, 83 nt, Homo sapiens
gcuugucgcugcgguguugcuguuggagacucgauuguuggugacagcgaaagaacgauaacaaaaugccggagcgagauagu

SEQ ID NO: 1718 - RNA, 69 nt, Homo sapiens
cuuucggccagcgggacggcauccgaggugggcuaggcucgggcccguggcgggugcgggggugggagg

SEQ ID NO: 1719 - RNA, 117 nt, Homo sapiens
ugugucccauaauuaaauaaugaaaucugaaaucaccaauaaugggacacuaaugugauuaauguuguugugucccauuauuggugauuucagauuucauauaugauuaaggacaua

SEQ ID NO: 1720 - RNA, 56 nt, Homo sapiens
uauuuaagaaaacaccauggagaugaaaugccuuugauuuuuuuuuucuuuuugua

SEQ ID NO: 1721 - RNA, 99 nt, Homo sapiens
ucuacaagcagauacaaggaugcccuuguacacaacacacgugcugcuuguauagacaugaguguugucuacgagggcauccuugugucugugugugug

SEQ ID NO: 1722 - RNA, 100 nt, Homo sapiens
gaaagaagaacuggacaaaauuaaaaugcucuucugucauuguaauaguucauaugggcacugacaggagagcauuuugacuuugucaagugugucugcu

SEQ ID NO: 1723 - RNA, 96 nt, Homo sapiens
caccuucucgcagaggcucuugaccugggacucggacagcugcuugcacucguucagcugcucgauccacugguccagcuccuuggugaacaccuu

SEQ ID NO: 1724 - RNA, 95 nt, Homo sapiens
uguguuuuccucaacgcucacaguuacacuucuuacucucaauccauucauauugaaaaugaugaguagugacugaugaagcacaaaucagccaa

SEQ ID NO: 1725 - RNA, 97 nt, Homo sapiens
cccgggaccuugguccaggcgcuggucugcguggugcucggguggauaagucugaucugagcaccacacaggccgggcgccgggaccaagggggcuc

SEQ ID NO: 1726 - RNA, 99 nt, Homo sapiens
cuguaaacuugaagguagggaacucugucuucacucaugaguaccuuccaacacgagcucucaggaguaaagacagaguucccuaccuucaauguggau

SEQ ID NO: 1727 - RNA, 105 nt, Homo sapiens
gcgggcggcggcggcggcagcagcagcaggugcggggcggcggccgcgcuggccgcucgacuccgcagcugcucguucugcuucuccagcuugcgcaccagcucc

SEQ ID NO: 1728 - RNA, 111 nt, Homo sapiens
aguaagguccgucaguuguaaugagacccagugcaaguguagaugccgacuccguggcagaguucagcguuucacacugccuggucucugucacucuauugaauuagauug

SEQ ID NO: 1729 - RNA, 74 nt, Homo sapiens
ugaggaugaaagacccauugaggagaagguucugcuggcugagaaccuuccucuccaugggucuuucauccuca

SEQ ID NO: 1730 - RNA, 75 nt, Homo sapiens
auauaugaaauguagagauugaucaaaauaguuucuaucaaaauaguuuugaucaaucucugcaauuuuauauau

SEQ ID NO: 1731 - RNA, 81 nt, Homo sapiens
auauauauauacggaauauauauacggaauauauauauacggaauauauauauacggaauauguauacggaauauauauau

SEQ ID NO: 1732 - RNA, 65 nt, Homo sapiens
ucuagacugguauagcugcuuuuggagccucaccugcugagagcucacagcuguccuucucuaga

SEQ ID NO: 1733 - RNA, 65 nt, Homo sapiens; identical to SEQ ID NO: 1732

SEQ ID NO: 1734 - RNA, 88 nt, Homo sapiens
auguuauugcugcugcugucacauuuacaugaaaauaaaauguaaauuauuuuauuucuaucaaauaaggacuagucugcagugauau

SEQ ID NO: 1735 - RNA, 82 nt, Homo sapiens
ucuuugugauuaccaugagacucauguaaaacaucuuagacuauuacaagauguuuuaugagucucaugauaaucacaaaga

SEQ ID NO: 1736 - RNA, 102 nt, Homo sapiens
auauauauauauggaauguauauacggaauauauauauauauggaauguauauacggaauauauauauauauggaauguauauacggaauauauauauauau

SEQ ID NO: 1737 - RNA, 68 nt, Homo sapiens
acaucacuauuguagaaccuaagauuggccguuugagauguccuuucaaguuuuugcauuucugaugu

SEQ ID NO: 1738 - RNA, 73 nt, Homo sapiens
ggaugauaaguuauggggcuucuguagagauuucuaugagaacaucucuaaggaacucccccaaacugaauuc

SEQ ID NO: 1739 - RNA, 85 nt, Homo sapiens
uugguuaaagcgccugucuaguaaacaggagauccuggguucgaaucccagcggugccuccguguuucccccacgcuuuugccaa

SEQ ID NO: 1740 - RNA, 60 nt, Homo sapiens
ggcaguggccagagcccugcagugcugggcaugggcuucucgugggcucuggccacggcc

SEQ ID NO: 1741 - RNA, 94 nt, Homo sapiens
gaauccgguccguacaaacucugcuguguugaaugauuggugaguuuguuugcucauugauugaaucacugcagaguuuguacggaccggauuc

SEQ ID NO: 1742 - RNA, 68 nt, Homo sapiens
cguggugaggauauggcagggaaggggaguuucccucuauucccuuccccccaguaaucuucaucaug

SEQ ID NO: 1743 - RNA, 87 nt, Homo sapiens
aaauuuaaggagggacucacucacaggauugugcaaaugcaaaguuggcuuuugcaugacccugggaguaggugccuccuuaaauuu

SEQ ID NO: 1744 - RNA, 87 nt, Homo sapiens; identical to SEQ ID NO: 1743

SEQ ID NO: 1745 - RNA, 72 nt, Homo sapiens
acuuccaguaguggaugaugcacucugugcagggccaacugugcacacagugcuucauccacuacuggaagu

SEQ ID NO: 1746 - RNA, 84 nt, Homo sapiens
uaaguuauauaugucuacuucuaccuguguuaucauaauaaaggugucaugaugauacagguggagguagaaauauauaacuua

SEQ ID NO: 1747 - RNA, 82 nt, Homo sapiens
ggguguacacccccugcgacauuggaaguaguaucaucucucccuuggaugcuacgaacaauaucacagaagguguacaccc

SEQ ID NO: 1748 - RNA, 74 nt, Homo sapiens
aaucuaaaggaccuguacuagguuuaacauguugagcauuacucauguuagaccuaguacacguccuuuagauu

SEQ ID NO: 1749 - RNA, 62 nt, Homo sapiens
guacauuuccuacccuaccugaagacuugagauuauagucuuuggggggaugggcaaaguac

SEQ ID NO: 1750 - RNA, 86 nt, Homo sapiens
cucaccucauucauuuaccuucucuuacagaucacuuuucugcacuggacagugaucuguaagagaaaguaaaugaaagaggugag

SEQ ID NO: 1751 - RNA, 61 nt, Homo sapiens
cgcgcgugcgcccgagcgcggcccgguggucccucccggacaggcguucgugcgacgugug

SEQ ID NO: 1752 - RNA, 93 nt, Homo sapiens
ucuucacuuucaagaguggcaaagucuuuccauauguauguauguaugucuguuacacauauggaaagacuuugccacucuuuaaagugaaga

SEQ ID NO: 1753 - RNA, 87 nt, Homo sapiens
ucacuuuaaagaguggcaaagucuuuccauauguguaacagacauacauacauacauauggaaagacuuugccacucuugaaaguga

SEQ ID NO: 1754 - RNA, 78 nt, Homo sapiens
ccugggaggugugauaucaugguuccugggaggugugauccugugcuuccugggaggugugauaucgugguuccuggg

SEQ ID NO: 1755 - RNA, 148 nt, Homo sapiens
gauccugugcucccuggggggucugauccugugcuuccugggaggugugauaucaugguuccugggaggugugaucccgugcuuccugggaggugugauauugugguuccugggaggugugaucccgugcucccugggaggugugauc

SEQ ID NO: 1756 - RNA, 72 nt, Homo sapiens
gggaggugugauaucgugguuccugggaggugugauaucgugguuccugggaggugugauauugugguuccu

SEQ ID NO: 1757 - RNA, 74 nt, Homo sapiens
ugggaggugugaucucacacucgcugggaggugugcuaucgucuuccccgggaggugugauccuguucuuccug

SEQ ID NO: 1758 - RNA, 80 nt, Homo sapiens
acugggaggugugaucucacacucgcugggaggugugcuaucgucuucccugggaggugugauccuguucuuccugagcg

SEQ ID NO: 1759 - RNA, 72 nt, Homo sapiens
gggaggugugauaucaugguuccugggagguaugauaucgugguuccugggaggugugaucccgugcucccu

SEQ ID NO: 1760 - RNA, 66 nt, Homo sapiens
aggugugauaucgugcuuccugggacgugugaugcugugcuuccugggaggugugaucccacacuc

SEQ ID NO: 1761 - RNA, 75 nt, Homo sapiens
cccaucuccaccuggacccagcguagacaaagagguguuucuacuccauaucuaccuggacccaguguagauggg

SEQ ID NO: 1762 - RNA, 90 nt, Homo sapiens
uugaggcacuggguaguggaugauggagacucgguacccacugcugaggguggggaccaagucugcgucauccucuccucagugccucaa

SEQ ID NO: 1763 - RNA, 69 nt, Homo sapiens
ccauuccugcuggucaggaguggauacuggagcaauagauacaguuccacacugacacugcagaagugg

SEQ ID NO: 1764 - RNA, 45 nt, Homo sapiens
gguauccguuuggggaugguuucacuauccccagauggauaccaa

SEQ ID NO: 1765 - RNA, 65 nt, Homo sapiens
gaaggcagcagugcuccccugugacgugcuccaucaccgggcagggaagacaccgcugccaccuc

SEQ ID NO: 1766 - RNA, 151 nt, Homo sapiens
ggguuggaaagcuguagguguggaggggcauggauacgggggccaugagggugggguccaggcuggaccaggccugcccugagucccccagcaggugcuccaggcuggcucacacccucugccucucucucuuccuuccuggccccaaccc

SEQ ID NO: 1767 - RNA, 126 nt, Homo sapiens
gccugagcaauguagguagacuguuucuaaaaaaauaaaaaguuaaaaaaauuuauguuaacguguaauguguuuacuaauuuuuuuuuuuuuuuuuggagacagagucucccucugucgccaggc

SEQ ID NO: 1768 - RNA, 119 nt, Homo sapiens
gguaugcuguugcgcuguccuuccucuggggagcaggcuccgggggacagggaaaagcacacaaggaacuuguccucuagggccugcagucucaugggagagugacaugcaccaggacc

SEQ ID NO: 1769 - RNA, 111 nt, Homo sapiens
cuuuugcugucaguuuuucuguugcuugucuugguuuuaugccuuuuauaucaaggcacauaaaaggcauaaaaccaagacaagcaacaaaaaaaggauugaucacagaag

SEQ ID NO: 1770 - RNA, 82 nt, Homo sapiens
uuuuuuuguugcuugucuugguuuuaugccuuuuaugugccuugauauaaaaggcauaaaaccaagacaagcaacagaaaaa

SEQ ID NO: 1771 - RNA, 109 nt, Homo sapiens
gggugaggauguguguggauccuggaggaggcagagaagacagugagcuugccaguucugguuuccaacacuuccuuuccugcgcuucucgauucccagaucugcaccc

SEQ ID NO: 1772 - RNA, 105 nt, Homo sapiens
agagaggaaugaacaguuaaauuauaacauguccauauuauggguuaguuguggacacauacuaacgcauaauauggacauguuauaauuuaacuguuccuuucu

SEQ ID NO: 1773 - RNA, 102 nt, Homo sapiens
uuguuuauaauaaacugaaauauuugggacugaucuugaugucugccaaaaccuuggcagacaucaagaucagucccaaauauuucaguuuauuauagacag

SEQ ID NO: 1774 - RNA, 100 nt, Homo sapiens
ugucuauaauaaacugaaauauuugggacugaucuugaugucugccaagguuuuggcagacaucaagaucagucccaaauauuucaguuuauuauaaaca

SEQ ID NO: 1775 - RNA, 99 nt, Homo sapiens
uggacuucagauuuaacuucucauuuucugguuccuucuaaugaguaugcuuaacuugguagaaggaaccagaaaaugagaaguugaguaggaacucua

SEQ ID NO: 1776 - RNA, 95 nt, Homo sapiens
gaguuccuacucaacuucucauuuucugguuccuucuaccaaguuaagcauacucauuagaaggaaccagaaaaugagaaguuaaaucugaaguc

SEQ ID NO: 1777 - RNA, 97 nt, Homo sapiens
caaguuggcacuguagaauauugaggaaaagauggucuuauugcaaagauuuucaauaagaccauccuuuccucaauauucuguggugucaucuuug

SEQ ID NO: 1778 - RNA, 94 nt, Homo sapiens
aucccagagaagaaggaagaagaggaagaaauggcugguucucaggugaaugugucuggguucaggggaugugucuccucuuuucuucugggau

SEQ ID NO: 1779 - RNA, 93 nt, Homo sapiens
ggcgcuuuugugcgcgcccgggucuguuggugcucagaguguggucaggcggcucggacugagcaggugggugcggggcucggaggaggcggc

SEQ ID NO: 1780 - RNA, 93 nt, Homo sapiens
aggcgguuaagccaugggacagggccgcagauggagacugcucaaggucaaaggggucuccagcugggacccugcaccugguucguagccccu

SEQ ID NO: 1781 - RNA, 89 nt, Homo sapiens
ccugagcaccauuuacugaguccuuuguucucuacuaguuuguaguaguucguagcagagaacaaaggacucaguaaauggugcucagg

SEQ ID NO: 1782 - RNA, 86 nt, Homo sapiens
acugagugagggagucagagaguuaagagaauuaguacaggugagauuguacugauuaucuuaacucucugacccccucacucagu

SEQ ID NO: 1783 - RNA, 85 nt, Homo sapiens
ccuagcccaguacaaggcauaugguacucaagagacuuagaaaucccuaagucucugaguaccauaugccuuguacugggcuagg

SEQ ID NO: 1784 - RNA, 84 nt, Homo sapiens
ggaagagucaagucaaggccagaggucccacagcagggcuggaaagcacaccugugggacuucuggccuugacuugacucuuuc

SEQ ID NO: 1785 - RNA, 83 nt, Homo sapiens
gguagagugagcucuaauccaauauuacuagcuucuuuauaagaagaggaaacuaguaauguuggauuagggcucacucuacu

SEQ ID NO: 1786 - RNA, 81 nt, Homo sapiens
uaaaugaaaaaguaguagucaaauaugcagaucuaugucauauauacagauauguauaugugacugcuacuuuuuuguuua

SEQ ID NO: 1787 - RNA, 77 nt, Homo sapiens
gugggaauagcaagagaacugaaaguggagccugucacaucuccagacuccaguuuuaguucucuugcuauuuccac

SEQ ID NO: 1788 - RNA, 73 nt, Homo sapiens
aaaauggagcuggccaaaaagcaggcagagacuuuaaaagcgucucugccugcuuuuuggccagcuccguuuu

SEQ ID NO: 1789 - RNA, 63 nt, Homo sapiens
ggagcuggccaaaaagcaggcagagacgcuuuuaaagucucugccugcuuuuuggccagcucc

SEQ ID NO: 1790 - RNA, 71 nt, Homo sapiens
ugccaaugccuaucacauaucugccuguccuaugacaaacauggcagguagauauuugauaggcauuggca

SEQ ID NO: 1791 - RNA, 58 nt, Homo sapiens
gcugaagcucuaagguuccgccugcgggcaggaagcggaggaaccuuggagcuucggc

SEQ ID NO: 1792 - RNA, 55 nt, Homo sapiens
aguggcucacaccaguaaucccagcacuuugggaggcugaugugaguagaccacu

SEQ ID NO: 1793 - RNA, 107 nt, Homo sapiens
cacagcccuuccuguccccaguuuucagguguggaaacugaggcaggaggcagugaaguaacuugcucagguugcacagcugggaaguggagcagggauuugaaucc

SEQ ID NO: 1794 - RNA, 104 nt, Homo sapiens
ggauguguuccugucccagaaggagcugaugguuguaucuaugaagguaagcauuuuuguagauacgagcaccagccacccuaagcaaaggcagagaaugcuua

SEQ ID NO: 1795 - RNA, 110 nt, Homo sapiens
augauucagagcaucuguccagugucugcuguagaucccucaaauccguguuuggacgcuucugguaagggguguauggcagaugcacccgacagaugcacuuggcagca

SEQ ID NO: 1796 - RNA, 106 nt, Homo sapiens
agaagaaugcccaaccagcccucaguugcuacaguucccuguuguuucagcucgacaacaacaggcggcuguagcaauggggggcuggaugggcaucucaaugugc

SEQ ID NO: 1797 - RNA, 103 nt, Homo sapiens
aggaauuuuuaacccgaucacuagauuaucuacaagggaauuuuuuuuuaauuuaaaaaauucccuuguagauaacccgguggucagguuggauggcuccaug

SEQ ID NO: 1798 - RNA, 106 nt, Homo sapiens
cuggcuuccaaaggccucuguguguuccuguaugugggcgugcacguaccugucacauguguacgcgcagaccacaggauguccacacuggcuuccaaacacaucu

SEQ ID NO: 1799 - RNA, 102 nt, Homo sapiens
gcuuaucgaggaaaagaucgagguggguuggggcgggcucuggggauuuggucucacagcccggaucccagcccacuuaccuugguuacucuccuuccuucu

SEQ ID NO: 1800 - RNA, 103 nt, Homo sapiens
gagucagaauucucaucaggcugugaugcucaguuguguguagauugaaagcccuaauuuuacacacaacugaggaucauagccugaugguuccuuuuuguuu

SEQ ID NO: 1801 - RNA, 109 nt, Homo sapiens
ucuucaguaugacaccucaaagaagcaauacuguuaccugaaauaggcugcgaagauaacaguauuucagauaacaguauuacaucuuugaagugucauauucacugac

SEQ ID NO: 1802 - RNA, 100 nt, Homo sapiens
cacacagacggcagcugcggccuagcccccaggcuucacuuggcguggacaacuugcuaaguaaaguggggggugggccacggcuggcuccuaccuggac

SEQ ID NO: 1803 - RNA, 108 nt, Homo sapiens
uccacccagcaggcgcagguccugugcagcaggccaaccgagaagcgccugcgucucccauuuucgggcuggccugcugcuccggaccugugccugaucuuaaugcug

SEQ ID NO: 1804 - RNA, 98 nt, Homo sapiens
gauguugaugcacgugacggggagggcauaggagaggguugauauaaaaugcaauuacagccucuuaugcuuuccaaagugggggaugauucaaugau

SEQ ID NO: 1805 - RNA, 91 nt, Homo sapiens
ggcgccccggcuccccgcgcccccgaucggggccgccgcuaguaguggcggcggcggaggcgggggcagcggcggcggcggcggaggcgcc

SEQ ID NO: 1806 - RNA, 87 nt, Homo sapiens
gcccauuugccuuggcuugggguggcaguccugugggaaugagagaugccaaacuggaccugccagccccguuccagggcacagcau

SEQ ID NO: 1807 - RNA, 107 nt, Homo sapiens
gcccaggguagcucucuguauugcuuguuacauuuuaggauugcuugccccuugcuccaauggugcaggcagaagaaaugcaaacaaaguacagcauuagccuuagc

SEQ ID NO: 1808 - RNA, 96 nt, Homo sapiens
guucagggaaaaggucauuguaagguuaaugcacccauauuuuaauaucaaacuaugacaaauuugacuacagccuuuccguaccccugccaaaac

SEQ ID NO: 1809 - RNA, 70 nt, Homo sapiens
cauguaggugagugauugcuauuucaaaagacuagagguaggaaaugaggcuaaugcacuacuucacaug

SEQ ID NO: 1810 - RNA, 139 nt, Homo sapiens
ugagggauauagagagcaggaagauuaaugucauauuggaguuggacugcagggcuuccuuuacacaauaaauauuguaugaagugcugauguaaccuuuacugcagcaugacaugggauuuggcuguuuuuauggcuc

SEQ ID NO: 1811 - RNA, 70 nt, Homo sapiens
uugugcuucaucguaauuaaccuuaagugguucggguaaaucacuuuaauuuguuauguguuggcagaau

SEQ ID NO: 1812 - RNA, 101 nt, Homo sapiens
ucaguggaaagcaugcauccaggguguggagccaaaauuagaagggccaaaauucuaccuggcccacuaccacagcaaccuugggcaucguuuucuuuuga

SEQ ID NO: 1813 - RNA, 61 nt, Homo sapiens
cacguccuccagcuuuuuuccuuaguggccaauuccugagaaaagggccaacgugcuucca

SEQ ID NO: 1814 - RNA, 63 nt, Homo sapiens
uggggggcuggcagcucaucaguccaggccaucuggccacugagucagcaccagcgcccaauc

SEQ ID NO: 1815 - RNA, 68 nt, Homo sapiens
ccagccaucgcccuugaggggcccuaggacuuacuugugcagggcauguccaggggguccaggucugc

SEQ ID NO: 1816 - RNA, 76 nt, Homo sapiens
cuugggaggagggugggguggcuccucugcagugaguaggucugccuggagcuacuccaccaucucccccagcccc

SEQ ID NO: 1817 - RNA, 72 nt, Homo sapiens
gagcauccuucaguguucagagauggagucaguauuggucuggccauuuuuagggcaaagaggcagcaucau

SEQ ID NO: 1818 - RNA, 64 nt, Homo sapiens
uguuccauuuaucugaccugaugaaggucuccuggcauugauuaggucugaugauccauuucug

SEQ ID NO: 1819 - RNA, 86 nt, Homo sapiens
ggcuuagaaacagucccuagguaggauuuggggaggagcuaagaagccccuacagggcccagagguggggacugagccuuaguugg

SEQ ID NO: 1820 - RNA, 91 nt, Homo sapiens
acgccccccgccccgccaccgccuuggaggcugaccucuuacuuucggucggucuucuucccugggcuugguuugggggcgggggaguguc

SEQ ID NO: 1821 - RNA, 101 nt, Homo sapiens
gaugggccccuuguguccugaauugggugggggcucugaguggggaaagugggggccuaggggaggucacaguugggucuaggggucaggagggcccagga

SEQ ID NO: 1822 - RNA, 67 nt, Homo sapiens
aacaaggugacuuggggcauggagucccacuuccuggagcccacaccccagcuugucacacaccaac

SEQ ID NO: 1823 - RNA, 58 nt, Homo sapiens
gguggaaguggguuccucccaguuccugagacaggaaacagggacccaggagaccagc

SEQ ID NO: 1824 - RNA, 54 nt, Homo sapiens
gaaagcugcaggugcugauguuggggggacauucagacuaccugcagcagagcc

SEQ ID NO: 1825 - RNA, 83 nt, Homo sapiens
auagugcucuucaggguuuuacuugggagauuggaguggccaguguuccuaaacaauucuaagugccuuggcccacaacauac

SEQ ID NO: 1826 - RNA, 66 nt, Homo sapiens
aaagcuggauacucagucauggucauuguaacaugauagugacagguacuggguaagacugcauag

SEQ ID NO: 1827 - RNA, 99 nt, Homo sapiens
ugcaguggguuggagcuucagccuacaccuguaaagaauuggucagccuggggacuggugaucucugcagcugugggcucagcucugggcugggccugg

SEQ ID NO: 1828 - RNA, 55 nt, Homo sapiens
ccacugcuggccggggccccuacucaaggcuaggaggccuuggccaaggacaguc

SEQ ID NO: 1829 - RNA, 82 nt, Homo sapiens
cucagcaggcuccagcucgguggcacugggggaaggcuccagaccccagccucugucaucccugcauggagcccacaucucc

SEQ ID NO: 1830 - RNA, 64 nt, Homo sapiens
augcacaucagguucuagagguuuugcccuagcggcuccuccucucaggaugugaugucaccug

SEQ ID NO: 1831 - RNA, 84 nt, Homo sapiens
acagcgcccugcaggcacagacagcccuggcuucugccucuuucuuuguggaagccacucugucaggccugggauggaggggca

SEQ ID NO: 1832 - RNA, 70 nt, Homo sapiens
acaaauagcuucagggagucaggggagggcagaaauagauggccuuccccugcugggaagaaaguggguc

SEQ ID NO: 1833 - RNA, 67 nt, Homo sapiens
aaaucucucuccauaucuuuccugcagcccccaggugggggggaagaaaagguggggaauuagauuc

SEQ ID NO: 1834 - RNA, 64 nt, Homo sapiens
uuuucugcacaaauuaaucaguuaaugcauagaaagcauucaacuagugauuguguuauaagag

SEQ ID NO: 1835 - RNA, 84 nt, Homo sapiens
uccccuguguguguucucugauggacaguaagccuugacuuauggcuaaaugcuucuucacaauggucacaugcauagggcuuu

SEQ ID NO: 1836 - RNA, 91 nt, Homo sapiens
ggggcauuuaggguaacugagcugcugccggggccuggcgcuccucuaccuugucaggugacccagcagucccucccccugcauggugccc

SEQ ID NO: 1837 - RNA, 87 nt, Homo sapiens
acauuuuuguccaauuaccacuucuuuuugccaccugagcacagucagcagucagcauaaaaaagugauaaugggaaguuaaugucu

SEQ ID NO: 1838 - RNA, 70 nt, Homo sapiens
cacagucugacucagugacucaugugcuggcaguggccacguaaauagagcuacugugucugaaagcaau

SEQ ID NO: 1839 - RNA, 84 nt, Homo sapiens
cugggucgaggcaguucugagcacaguacacugggcugcccccacugcccagugcccugcucagcucaaguccuugugccccuc

SEQ ID NO: 1840 - RNA, 69 nt, Homo sapiens
aucuaacaccaggagaaucccauagaacauugacaucaacacuaggggguuugcccuuguggggaagaa

SEQ ID NO: 1841 - RNA, 58 nt, Homo sapiens
ugcucuguggagcugaggagcagauucucucucucuccucccggcuucaccuccugag

SEQ ID NO: 1842 - RNA, 76 nt, Homo sapiens
aaucaggguggaguguaguucugagcagagccuuaaaggaugagguauguucaagacugaaugacaccuuugugau

SEQ ID NO: 1843 - RNA, 62 nt, Homo sapiens
gcugggggucccccgacaguguggagcuggggccgggucccggggagggggguucugggcag

SEQ ID NO: 1844 - RNA, 67 nt, Homo sapiens
ggugaaguuccaggggaagauuuuaguaugccacauuucuaaaauuugcauccaggaacaucauccu

SEQ ID NO: 1845 - RNA, 80 nt, Homo sapiens
acucugauccuggggcucagcgaguuugcaagggguguuucuguccauggucaggcuugccagccuugguccuugggccc

SEQ ID NO: 1846 - RNA, 80 nt, Homo sapiens; identical to SEQ ID NO: 1845

SEQ ID NO: 1847 - RNA, 81 nt, Homo sapiens
guucugugaggggcucacaucaccccaucaaaguggggacucauggggagaggggguaguuaggagcuuugauagaggcgg

SEQ ID NO: 1848 - RNA, 85 nt, Homo sapiens
auuagcuggggcggcgaguccgacucaucaauauuuuaaggaaugacccggccuuggggugcggaauugcugcgcgggcgggggc

SEQ ID NO: 1849 - RNA, 93 nt, Homo sapiens
uacuuauggcaccccacuccugguaccauagucauaaguuaggagauguuagagcugugaguaccaugacuuaagugugguggcuuaaacaug

SEQ ID NO: 1850 - RNA, 78 nt, Homo sapiens
uaguucuuuuucucccuugagggcacuuuucaguuccugagaucaauguggucccuacuggggagaccauaggagccc

SEQ ID NO: 1851 - RNA, 67 nt, Homo sapiens
auggagguggagagucaucagcagcacugagcaggcaguguugucugcugaguuuccacgucauuug

SEQ ID NO: 1852 - RNA, 70 nt, Homo sapiens
ccuugggagggcauugugcagggcuaucaggcaguuuccugggcccugucugcagagccuaaacagauca

SEQ ID NO: 1853 - RNA, 95 nt, Homo sapiens
gccaccaagaaggugaagggagggucagucccaaucugaaucccaccaaaauaggugguagaggguugcccuccuuucuucccucaccucugacc

SEQ ID NO: 1854 - RNA, 65 nt, Homo sapiens
cgccgggggcuucagcaggaacagcuggguggaggcagagcuguucugcuguggcugcagcccug

SEQ ID NO: 1855 - RNA, 67 nt, Homo sapiens
gagacaccagaaggccaccugcuuaggaggccagaggugccccugggccggccuuggugaggggccc

SEQ ID NO: 1856 - RNA, 78 nt, Homo sapiens
agagacaccuguuccuugggaagcuggugacauugcuaauucauuucacaccagccugacaggaacagccugacugaa

SEQ ID NO: 1857 - RNA, 76 nt, Homo sapiens
ccgaugccucgggagucuacagcagggccaugucugugagggcccaagggugcaugugucucccagguuucggugc

SEQ ID NO: 1858 - RNA, 85 nt, Homo sapiens
cuuuguggaacagugcaauguuuuccuugccuguggcaagaccacuucgguucaaggcuaagaaacuagacuguuccuacagaga

SEQ ID NO: 1859 - RNA, 88 nt, Homo sapiens
uugggcuuugaugugggcucaggcucagagggcugaagugguuguggggaggggcuucuggggacuguguccaugucucugucguuuu

SEQ ID NO: 1860 - RNA, 76 nt, Homo sapiens
agcacgcacgugccuuccugucugugccugccuucgaagugcacggcagggccaggacgggucgcugugggugggg

SEQ ID NO: 1861 - RNA, 73 nt, Homo sapiens
ggggagguaccugggacaggaggaggaggcagccuugccucagaaaccaaacugucaaaaguguagguuccac

SEQ ID NO: 1862 - RNA, 72 nt, Homo sapiens
ggguucugaccaaucauguuacaguguuuucuccuuuagagagagcuggugacaugagaggcagaaaaagga

SEQ ID NO: 1863 - RNA, 96 nt, Homo sapiens
ugaguuuagaagagggccagcuaaaucagcagagacaugaggugaucaaaaaccuuuuuucaaagcagugggagcuggacuacuucugaaccaaua

SEQ ID NO: 1864 - RNA, 66 nt, Homo sapiens
accagccaccucccacuacuucacuugugaacauugcauucguggaggguggcaggugcagcucug

SEQ ID NO: 1865 - RNA, 60 nt, Homo sapiens
ucaggagggaccaguguggcucagcgagguggcugaguuuacuuaagguauuggaaugag

SEQ ID NO: 1866 - RNA, 66 nt, Homo sapiens
agaaaauagcuucugagcugaggacagcuugcucugcuuuucuuuagcuuaggagcuaaccauggu

SEQ ID NO: 1867 - RNA, 62 nt, Homo sapiens
agagaaguggccggcauguccagggcauccccauugcucugugacugcugccauccuucucc

SEQ ID NO: 1868 - RNA, 102 nt, Homo sapiens
cugccuuagaccuagacaccuccaguucuggguucuuagaggccuaauccucuacaaacucaguuuucagacugugagggaaauucucugucuuauugcuuu

SEQ ID NO: 1869 - RNA, 91 nt, Homo sapiens
aagcugcuuaguguccuuagagucuccagaggcaucccuaacccagaaucuuuugacuguccucuggagagaaaggcaguaggucuguacc

SEQ ID NO: 1870 - RNA, 84 nt, Homo sapiens
ucagaagaaaaaacaggagauaaaguuugugauaauguuugucuauauaguuaugaauguuuuuuccuguuuccuucagggcca

SEQ ID NO: 1871 - RNA, 81 nt, Homo sapiens
uauggguucagagggaacuccauuggacagaaauuuccuuuugaggaaaucuuucccuggaguuucuucuuaccuuuuucc

SEQ ID NO: 1872 - RNA, 83 nt, Homo sapiens
ucuggggguucuggagucuaggauuccaggaucuggguuuugaggucuuggguuguagggucugcgguuugaagccccucuug

SEQ ID NO: 1873 - RNA, 57 nt, Homo sapiens
uggcgucuggggccugaggcugcagaacauugcagcauucaugucccacccccacca

SEQ ID NO: 1874 - RNA, 100 nt, Homo sapiens
ucagagaggggaaagagagcugagugugaccuggagcagcucaggagggcuuccugggugagguggcagguuacagguucgaucuuuggcccucagauuc

SEQ ID NO: 1875 - RNA, 76 nt, Homo sapiens
gaaagguugggggcacagagagcaaggagccuuccccagaggagucaggccuuguuccuguccccauuccucagag

SEQ ID NO: 1876 - RNA, 101 nt, Homo sapiens
gaucaggcccagcccccuggccccaaacccugcagccccagcuggaggaugaggagaugcugggcuugggugggggaaucagggguguaaaggggccugcu

SEQ ID NO: 1877 - RNA, 92 nt, Homo sapiens
ggccauuccucucugggaaaugggacagguaguggccacagugagaaagcuggccuguccuucugccccagggcccagagucugugacugga

SEQ ID NO: 1878 - RNA, 73 nt, Homo sapiens
ugggcuuugcccgcuuucugagcuggacccucucucuaccucuggugcagaacuacagcggaaggaaucucug

SEQ ID NO: 1879 - RNA, 73 nt, Homo sapiens; identical to SEQ ID NO: 1878

SEQ ID NO: 1880 - RNA, 71 nt, Homo sapiens
aguggcccagggugaggcuagcugguguggucacccacucuccagcccagccccaaucccaccacaaccac

SEQ ID NO: 1881 - RNA, 65 nt, Homo sapiens
aaaaggcgagacauugccagggaguuuauuuuguagcucucuugauaaaauguuuuagcaaacac

SEQ ID NO: 1882 - RNA, 81 nt, Homo sapiens
gcuucuuaauuaugucauaaacccacuguggacaagggccuugucuuagacagucacuguggguacaugcuaggugcucaa

SEQ ID NO: 1883 - RNA, 85 nt, Homo sapiens
uuggcuugagucccugagcaaagccacugggaaugcucccugaggacguuauaugagugcucagcucauggggcuaugaugguca

SEQ ID NO: 1884 - RNA, 65 nt, Homo sapiens
gacaugugggguuugcuguagacauuucagauaacucgggauucuguagcuuccuggcaacuuug

SEQ ID NO: 1885 - RNA, 80 nt, Homo sapiens
cuggucuccgcagagccucugccccucccgagacacccgcuaccugguguuagcgguggaccgcccugcgggggccuggc

SEQ ID NO: 1886 - RNA, 73 nt, Homo sapiens
accgcgaguuccgcgccuggccgugucgccccacgagggggacugugggcucagcgcguggggcccggagcau

SEQ ID NO: 1887 - RNA, 69 nt, Homo sapiens
cggggcccaggcgggcauguggggugucuggagacgccaggcagccccacagccucagaccucgggcac

SEQ ID NO: 1888 - RNA, 72 nt, Homo sapiens
cggccccuuuguuaagggucucagcuccagggaacuuuaaaacccugagacccuaaccuuaaaggugcugca

SEQ ID NO: 1889 - RNA, 90 nt, Homo sapiens
ggggaagauguugcacuugucucagugagagaugcuucuagauccaggaggcagaccucaaggauggagagaaggcagauccuuugagau

SEQ ID NO: 1890 - RNA, 59 nt, Homo sapiens
gcugcucugcuguuccucugucucccagacucuggguggauggagcaggucgggggcca

SEQ ID NO: 1891 - RNA, 85 nt, Homo sapiens
ggccuggguaggcuugcaugggggacugggaagagaccaugaacagguuaguccagggaguucucaucaagccuuuacucaguag

SEQ ID NO: 1892 - RNA, 56 nt, Homo sapiens
aacaguugaguccugagaaccauugagaaccaguuuucccaggauuaacuguuccg

SEQ ID NO: 1893 - RNA, 71 nt, Homo sapiens
uagagaggaagguguaccaggguuuuggaguuuuuuuuuccuccugagacccuaguuccacauucuggagc

SEQ ID NO: 1894 - RNA, 105 nt, Homo sapiens
aauugucagcaggcaauuaucugaggaugcaggagaggaagggggcuucuuuuugacgccuacuucaucagcugcuccucagaucagagccuugcaggucaggcc

SEQ ID NO: 1895 - RNA, 73 nt, Homo sapiens
gaaaacaaccaggugggcuucccggagggcggaacacccagccccagcauccagggcucaccuaccacguuug

SEQ ID NO: 1896 - RNA, 62 nt, Homo sapiens
ugguuuuugcucugagugaccguggugguugugggagucacugcaggacucagcaggaauuc

SEQ ID NO: 1897 - RNA, 77 nt, Homo sapiens
ugguggugugugccuguagucuuagcuacucgggaggcugagggaggagacugcagugaguggaggucacgccacug

SEQ ID NO: 1898 - RNA, 68 nt, Homo sapiens
cucaggcucaguggugcaugcuuauagucccagccacucuggaggcugaaggaagauggcuugagccu

SEQ ID NO: 1899 - RNA, 77 nt, Homo sapiens
cucuugguaugaacaucuguguguucaugucucucugugcacaggggacgagagucacugaugucuguagcugagac

SEQ ID NO: 1900 - RNA, 69 nt, Homo sapiens
cugggucuccuuucugcugagaguugaacacuuguugggacaaccugucuguggaaaggagcuaccuac

SEQ ID NO: 1901 - RNA, 83 nt, Homo sapiens
aguucuucugcagacaaaagcaucaggaaguacccaccauguaccagugggcccuucuugaugcucuugauugcagaggagcc

SEQ ID NO: 1902 - RNA, 80 nt, Homo sapiens
aucauguacugcaguugccuuuuuguucccaugcuguuuaagccuagcauaggcaccaaaaagcaacaacaguaugugaa

SEQ ID NO: 1903 - RNA, 86 nt, Homo sapiens
cuuacaucacacacagaguuaacucaaaauggacuaauuuuuccacuaguuaguccauuucaaguuaacucugugugugauguagu

SEQ ID NO: 1904 - RNA, 84 nt, Homo sapiens
gugcuuuacaugaauggucccauugaaucccaacagcuuugcgaaguguuguugggauucagcaggaccauucguguaaaguaa

SEQ ID NO: 1905 - RNA, 63 nt, Homo sapiens
aguuggaagauggacguacuuugucugacuacaauauucaaaaggagucuacucuucaucuug

SEQ ID NO: 1906 - RNA, 68 nt, Homo sapiens
gaagccucuuggggcuuauuuagacaaugguuucaucauuucgucugaauagagucugaagagucuuu

SEQ ID NO: 1907 - RNA, 73 nt, Homo sapiens
uuggcaggugccauguugccugcuccuuacuguacacguggcuggcaaggagacgggaacauggagccgccau

SEQ ID NO: 1908 - RNA, 73 nt, Homo sapiens
agggagaaaagcugggcugagaggcgacuggugucuaauuuguuugucucuccaacucagacugccuggccca

SEQ ID NO: 1909 - RNA, 49 nt, Homo sapiens
gugaggcuggagugagcggagaucguaccacugcacuccaaccugguga

SEQ ID NO: 1910 - RNA, 94 nt, Homo sapiens
ugguuugcgacucugaaaacuagaagguuuaugacugggcauuucucacccaaugcccaauauugaacuuucuaguugucagagucauuaaccc

SEQ ID NO: 1911 - RNA, 84 nt, Homo sapiens
gcaucuugcagagccguuccaaugcgacaccucuagagugucauccccuagaaugucaccuuggaaagacucugcaagaugccu

SEQ ID NO: 1912 - RNA, 81 nt, Homo sapiens
cauccuccuuacgucccaccccccacuccuguuucuggugaaauauucaaacaggagugggggugggacauaaggaggaua

SEQ ID NO: 1913 - RNA, 53 nt, Homo sapiens
ucacuuuaggagaaguaaaguagaacuuugguuuucaacuuuuccuacagugu

SEQ ID NO: 1914 - RNA, 80 nt, Homo sapiens
aggcagcaaauggccagagcucacacagagggaugagugcacuucaccugcagugugacucagcaggccaacagaugcua

SEQ ID NO: 1915 - RNA, 74 nt, Homo sapiens
gcaaauggccagagcucacacagagggaugagugcacuucaccugcagugugacucagcaggccaacagaugcu

SEQ ID NO: 1916 - RNA, 85 nt, Homo sapiens
gccucacuuuuccacuuaugccugcccugccccucgaaucugcuccacgauuugggcaggacaggcagaaguggauaagugagga

SEQ ID NO: 1917 - RNA, 91 nt, Homo sapiens
guguccucacuuguccacuucugccugcccugcccaaaugguggagcagauucgaggggcagggcaggaagaaguggacaagugaggccau

SEQ ID NO: 1918 - RNA, 91 nt, Homo sapiens; identical to SEQ ID NO: 1917

SEQ ID NO: 1919 - RNA, 60 nt, Homo sapiens
acuuugugcauuggguccacaaggaggggaugacccuugugggcucaggguacaaagguu

SEQ ID NO: 1920 - RNA, 93 nt, Homo sapiens
uaaguguaaacuuaaggacugucuuuucuaagccugugccuugccuuuccuuuggcacaggcuuagaaaagacagucuuuaaguuuacacuuc

SEQ ID NO: 1921 - RNA, 80 nt, Homo sapiens
ccagugacugauaccuuggaggcauuuuaucuaagauacacacaaagcaaaugccucuaagguaucaguuuaccaggcca

SEQ ID NO: 1922 - RNA, 98 nt, Homo sapiens
cucucaccaagcaagugcaguggggcuugcuggcuugcaccgugacucccucucaccaagcaagugucguggggcuugcuggcuugcacugugaagau

SEQ ID NO: 1923 - RNA, 100 nt, Homo sapiens
cagagucuccuucguguacagggaggagacuguacgugagagauagucagauccgcauguuagagcagagucuccuucguguacagggaggagauuguac

SEQ ID NO: 1924 - RNA, 67 nt, Homo sapiens
gcgcccucccucucuccccggugugcaaaugugugugugcgguguuaugccggacaagagggaggug

SEQ ID NO: 1925 - RNA, 53 nt, Homo sapiens
gguggggguuggaggcguggguuuuagaaccuaucccuuucuagcccugagca

SEQ ID NO: 1926 - RNA, 74 nt, Homo sapiens
gugacgacuggccccgccucuuccucucggucccauauugaacucgaguuggaagaggcgaguccggucucaaa

SEQ ID NO: 1927 - RNA, 74 nt, Homo sapiens; identical to SEQ ID NO: 1926

SEQ ID NO: 1928 - RNA, 70 nt, Homo sapiens
uuccugcagauuguuucuuuugccgugcaaguuuaaguuuuugcacggcaaaagaaacaauccagagggu

SEQ ID NO: 1929 - RNA, 67 nt, Homo sapiens
cugguccauuucccugccauucccuuggcuucaauuuacucccagggcuggcagugacaugggucaa

SEQ ID NO: 1930 - RNA, 91 nt, Homo sapiens
guucuagagcaugguuucucaucauuugcacuacugauacuuggggucagauaauuguuuguggugggggcuguuguuugcauuguaggau

SEQ ID NO: 1931 - RNA, 86 nt, Homo sapiens
aggagugaccaaaagacaagagugcgagccuucuauuaugcccagacagggccaccagagggcuccuuggucuagggguaaugcca

SEQ ID NO: 1932 - RNA, 66 nt, Homo sapiens
agcagcccucggcggcccggggggcgggcggcggugcccgucccggggcugcgcgaggcacaggcg

SEQ ID NO: 1933 - RNA, 65 nt, Homo sapiens
ugucuggggauuuggagaaguggugagcgcaggucuuuggcaccaucuccccuggucccuuggcu

SEQ ID NO: 1934 - RNA, 66 nt, Homo sapiens
ucuguaccucagcuuugcucccaaccaaccacuuccacauguuuugcugguagagcugaggacagc

SEQ ID NO: 1935 - RNA, 71 nt, Homo sapiens
uggaucacuugaggccaagagugcaaggcuguagugugcacagccuugaauucuuggccuuaagugauccc

SEQ ID NO: 1936 - RNA, 89 nt, Homo sapiens
uggagagcuuggucuguagcgguuuccuucggggcagguggggacugcuccuuugggaggaaggaggaggcccaggccgcgucuucagg

SEQ ID NO: 1937 - RNA, 55 nt, Homo sapiens
ccggauccgagucacggcaccaaauuucaugcguguccgugugaagagaccacca

SEQ ID NO: 1938 - RNA, 58 nt, Homo sapiens
agaaggguguguguguuuuuccugagaauaagagaaggaaggacagccaaauucuuca

SEQ ID NO: 1939 - RNA, 43 nt, Homo sapiens
augaaccugguggcuuccuuuucugggaggaaguuaggguuca

SEQ ID NO: 1940 - RNA, 68 nt, Homo sapiens
ggaguacuccagucaauaccgugugaguuagaaaagcucaauucacaagguauugacuggcguauuca

SEQ ID NO: 1941 - RNA, 75 nt, Homo sapiens
gagcgcacagagguagguguggaagaaagugaaacacuauuuuagguuuuaguuacacucugcuguggugugcug

SEQ ID NO: 1942 - RNA, 66 nt, Homo sapiens
acccaggaggcggaggagguggagguugcagugagccaagaucguggcacugacuccagccugggg

SEQ ID NO: 1943 - RNA, 86 nt, Homo sapiens
guuuuuugcccauagugguugugaauuuaccuucuccucuuugcagugauaaaggagguaaauucacaaccacugugggcagaaac

SEQ ID NO: 1944 - RNA, 74 nt, Homo sapiens
gaguaggcuuagguuauguacguagucuaggccauacguguuggagauugagacuaguagggcuaggccuacug

SEQ ID NO: 1945 - RNA, 58 nt, Homo sapiens
cuucccagcugcccuaagucaggaguggcuuuccugacacggaggguggcuugggaaa

SEQ ID NO: 1946 - RNA, 67 nt, Homo sapiens
aauagauuauuggucaccaccuccaguuucugaauuugugagacugggguggggccugagaauuugc

SEQ ID NO: 1947 - RNA, 92 nt, Homo sapiens
ggaaccuuaguaagguuuggauagaugcaauaaaguauguccacagcugaaaggacauacuuuauugcauguauccaaaccuuacuaauuca

SEQ ID NO: 1948 - RNA, 70 nt, Homo sapiens
cauguguccccuggcacgcuauuugagguuuacuauggaaccucaaguagucugaccaggggacacauga

SEQ ID NO: 1949 - RNA, 54 nt, Homo sapiens
acgcgggugcgggccggcgggguagaagccacccggcccggcccggcccggcga

SEQ ID NO: 1950 - RNA, 63 nt, Homo sapiens
ugguggcggcgguaguuaugggcuucucuuucucaccagcagccccugggccgccgccucccu

SEQ ID NO: 1951 - RNA, 64 nt, Homo sapiens
agucuucuccuggggcuuugguggcuaugguugacugggccacucagagcagaaggaugagaug

SEQ ID NO: 1952 - RNA, 79 nt, Homo sapiens
ccgacgcggagagcggcucuagguggguuuggcggcggcgaggacaccgccgcucccucuagggucgcucggagcguga

SEQ ID NO: 1953 - RNA, 72 nt, Homo sapiens
cgagccucuuucggcuuuccaguuugucucgguccuuuggaacguggcaaacguggaagccgagagggcucu

SEQ ID NO: 1954 - RNA, 83 nt, Homo sapiens
ccaaauuuaaaacuuaaaccucuacuaaguuuccaugaaaagaacccaugggaacuuaguagagguuuaaguuuuaaauuuga

SEQ ID NO: 1955 - RNA, 80 nt, Homo sapiens
uggcagacccuugcucucucacucucccuaauggggcugaagacagcucaggggcagggugggggguguuguuuuuguuu

SEQ ID NO: 1956 - RNA, 67 nt, Homo sapiens
uggugggggugggggguguuguuuuuguuuuugagacagagucuugcuccgucgcccaggccggagu

SEQ ID NO: 1957 - RNA, 91 nt, Homo sapiens
aaggaacaggggacacuuguaauggagaacacuaagcuauggacugcuauggacugcuagugcucuccguuacaaguauccccuguuaccu

SEQ ID NO: 1958 - RNA, 78 nt, Homo sapiens
uugccuaccuuguuagucucaugaucagacacaaauauggcucuuuguggcuggucaugaggcuaacaagguaggcac

SEQ ID NO: 1959 - RNA, 61 nt, Homo sapiens
aucucaaugagugugugguucuaaaugacucauagucaagggaccaagcauucauuaugaa

SEQ ID NO: 1960 - RNA, 70 nt, Homo sapiens
aaaagccugucccuaagucccucccagccuuccagaguuggugccaggaaggauuuagggacaggcuuug

SEQ ID NO: 1961 - RNA, 81 nt, Homo sapiens
uccuccucccaucaaucacaaauguccuuaauggcauuuaaggauugcuauuaaggacauuugugauucacgggaggaggu

SEQ ID NO: 1962 - RNA, 81 nt, Homo sapiens
accuccucccgugaaucacaaauguccuuaauagcaauccuuaaaugccauuaaggacauuugugauugaugggaggagga

SEQ ID NO: 1963 - RNA, 86 nt, Homo sapiens
ggccgaggcugagcugaggagccuccaaaccuguagacagggucaugcaguacuaggggcgagccucauccccugcagcccuggcc

SEQ ID NO: 1964 - RNA, 71 nt, Homo sapiens
gaaaccaaguccgagcguggcuggcgcgggaaaguucgggaacgcgcgcggccgugcucggagcagcgcca

SEQ ID NO: 1965 - RNA, 71 nt, Homo sapiens
gcagaggugaguugaccuccacagggccacccagggaguaaguagccaaguggaaguuacuuuaccucugu

SEQ ID NO: 1966 - RNA, 60 nt, Homo sapiens
ggagugggcuggugguuuuuuaagaggaagggagaccuaagcuagcacaugagcacgcuc

SEQ ID NO: 1967 - RNA, 70 nt, Homo sapiens
agugagcaacccagugggcuauggaaauguguggaagauggcauuucuauuucucaguggggcucuuacc

SEQ ID NO: 1968 - RNA, 98 nt, Homo sapiens
aauaaaaauugaauagugagcaacccagugggcuauggaaauguguggaagauggcauuucuauuucucaguggggcucuuaccuauuacucaucaac

SEQ ID NO: 1969 - RNA, 62 nt, Homo sapiens
aaaaaacaacauacuuagugcauacccauauaauauuagggguggucuguuguuguuuuucu

SEQ ID NO: 1970 - RNA, 83 nt, Homo sapiens
ggguuuccucugccuuuuuuuccaaugaaaauaacgaaaccuguuauuucccauugagggggaaaaaggcgggagaagcccca

SEQ ID NO: 1971 - RNA, 57 nt, Homo sapiens
agaggcaccgccugcccagugacaugcguuuaacggccgcgguacccuaacugugca

SEQ ID NO: 1972 - RNA, 63 nt, Homo sapiens
gcaugcugggcgaggcuggcaucuagcacaggcgguagaugcuugcucuugccauugcaauga

SEQ ID NO: 1973 - RNA, 73 nt, Homo sapiens
acuguccuucagccagagcuggcugaagggcagaagggaacuguccuucagccagagcuggcugaagggcaga

SEQ ID NO: 1974 - RNA, 62 nt, Homo sapiens
gguagggggcgggcuccggcgcugggaccccacuaggguggcgccuuggccccgccccgccc

SEQ ID NO: 1975 - RNA, 62 nt, Homo sapiens
ggggguggggcuagugaugcaggacgcuggggacuggagaaguccugccugacccuguccca

SEQ ID NO: 1976 - RNA, 84 nt, Homo sapiens
auaguuucugcaaugcucaaaucucuggccaaagaccagaacuuaauggucucugguaagagauuugggcauauuagaaacuaa

SEQ ID NO: 1977 - RNA, 68 nt, Homo sapiens
acauuuggucacaccaguccacauuaacguggaccagacaauauuaauguggacuggugugaccaaaa

SEQ ID NO: 1978 - RNA, 80 nt, Homo sapiens
cugcagcgugcuucuccaggccccgcgcgcggacagacacacggacaagucccgccaggggcugggcgcgcgccagccgg

SEQ ID NO: 1979 - RNA, 73 nt, Homo sapiens
ccagagaugggaaggccuuccggugauuaucacagccaugccuuuaccuccagaaggccuuuccaucucuguc

SEQ ID NO: 1980 - RNA, 84 nt, Homo sapiens
aguuuuaguuacccuggucaucugcagucugaaaauacaaaauggaaaauuccagacuguggcugaccagagguaacugaaacc

SEQ ID NO: 1981 - RNA, 66 nt, Homo sapiens
aagaaauguaaacaggcuuuuugcucaguggaguuauuuugagcaaaaagcuuauuuacauuucug

SEQ ID NO: 1982 - RNA, 61 nt, Homo sapiens
acaucagcucauauaauccucgaagcugccuuuagaaaugaggaaacugaagcugagaggg

SEQ ID NO: 1983 - RNA, 89 nt, Homo sapiens
accuccgggacggcugggcgccggcggccgggagauccgcgcuuccugaaucccggccggcccgcccggcgcccguccgcccgcggguc

SEQ ID NO: 1984 - RNA, 66 nt, Homo sapiens
agggcugggcuggcagggcaagugcugcagaucuuugucuaagcagccccugccuuggaucuccca

SEQ ID NO: 1985 - RNA, 69 nt, Homo sapiens
aagacugagaggagggaacuggugaguuguacauagaaaugcuuucuaacuccuugucucagucuguuu

SEQ ID NO: 1986 - RNA, 76 nt, Homo sapiens
caggagagaaaguacugcccagaagcuaaaguguagaucaaacgcauaauggcugagguaguaguuucuugaacuu

SEQ ID NO: 1987 - RNA, 64 nt, Homo sapiens
uaugugaccucggaugaaucacugaaauaugucugagcuucuguuucaucagaugucacauuuu

SEQ ID NO: 1988 - RNA, 81 nt, Homo sapiens
agccuuuagcaaguuguaaucuuuuugcugauggagggucuugccuccauggggauggcugaugaugauggugcugaaggc

SEQ ID NO: 1989 - RNA, 83 nt, Homo sapiens
acaauguagauauuuaagcaggaaauagaauuuacauauaaauuucuauuuguuucuauuuccugcuuaaauaucuacauugc

SEQ ID NO: 1990 - RNA, 92 nt, Homo sapiens
cuaagauaauguccuccagguucaucucuguugucauuuguggcauggaccauuugugacaauagagaugaacauggaggauauuaucuuaa

SEQ ID NO: 1991 - RNA, 73 nt, Homo sapiens
ggaggcugggcugggacggacacccggccuccacuuucuguggcagguaccuccuccaugucggcccgccuug

SEQ ID NO: 1992 - RNA, 77 nt, Homo sapiens
uggccucugccaucagaccaucuggguucaaguuuggcuccaucuuuaugaaauggguggucugaggcaaguggucu

SEQ ID NO: 1993 - RNA, 52 nt, Homo sapiens
ucugggcugagccgagcuggguuaagccgagcuggguugggcugggcugggu

SEQ ID NO: 1994 - RNA, 70 nt, Homo sapiens
aggacccagcggggcugggcgcgcggagcagcgcugggugcagcgccugcgccggcagcugcaagggccg

SEQ ID NO: 1995 - RNA, 94 nt, Homo sapiens
cuuuaauacuaucucaaacuaaaggauauagaagguuuucccuuucucuugcccugaaaccuucuguauccuuuauuuugagauaguauuagaa

SEQ ID NO: 1996 - RNA, 94 nt, Homo sapiens; identical to SEQ ID NO: 1995

SEQ ID NO: 1997 - RNA, 94 nt, Homo sapiens; identical to SEQ ID NO: 1995

SEQ ID NO: 1998 - RNA, 68 nt, Homo sapiens
guguaugugagggaguaggauguaugguuguuagauagacaacuacaaucuuuucucacaacagacag

SEQ ID NO: 1999 - RNA, 87 nt, Homo sapiens
aaaaaaaagggaaagaagaacuguugcauuugcccugcacucaguuugcacaggguaaaugcaauaguucuucuuucccuuuuuuua

SEQ ID NO: 2000 - RNA, 77 nt, Homo sapiens
cucagcccgggcaauauagugagaccucgucucuacaaaaaauugagacagggccucacuguaucgcccaggcugga

SEQ ID NO: 2001 - RNA, 86 nt, Homo sapiens
auucuagguggggagacugacggcuggaggcccauaagcugucuaaaacuucggcccccagauuucuggucuccccacuucagaac

SEQ ID NO: 2002 - RNA, 57 nt, Homo sapiens
guugagacaggcaggauuggggaaacaucuuuuaccucgucucuugccuguuuuaga

SEQ ID NO: 2003 - RNA, 81 nt, Homo sapiens
gcgggagguguaacaggacuggacucccggcagccccagggcaggggcguggggagcugguccuagcucagcgcucccgga

SEQ ID NO: 2004 - RNA, 86 nt, Homo sapiens
agggagaagggucggggcagggagggcagggcaggcucugggguggggggucugugagucagccacggcucugcccacgucucccc

SEQ ID NO: 2005 - RNA, 79 nt, Homo sapiens
agguaaauaugaugaaacucacagcugaggagcuuagcaaguagcuaaggccagagcuuguguuugggugguguggcug

SEQ ID NO: 2006 - RNA, 83 nt, Homo sapiens
ugggggaaaagugcugggauugauuagugaugucugcuggggaaccggggcucagggaugauaacugugcugagaagcccccu

SEQ ID NO: 2007 - RNA, 58 nt, Homo sapiens
aaccucagcagugcgcagggcugcacugucuccgucugcggccugcaguaagcgggua

SEQ ID NO: 2008 - RNA, 70 nt, Homo sapiens
gugugccaccugcguguuuucuguccaaaucagaaaaggauuuggacagaaaacacgcaggaagaaggaa

SEQ ID NO: 2009 - RNA, 54 nt, Homo sapiens
ccugcguguuuucuguccaaauccuuuucugauuuggacagaaaacacgcaggu

SEQ ID NO: 2010 - RNA, 60 nt, Homo sapiens
ucggcuaaggaaguccugugcucaguuuuguagcaucaaaacuaggauuucucuuguuac

SEQ ID NO: 2011 - RNA, 87 nt, Homo sapiens
gcgggcguugccugggggccucgcagggggagauccagcccaggcugguuccgcugacucugccuguaggccgguggcgucuucugg

SEQ ID NO: 2012 - RNA, 69 nt, Homo sapiens
gcgggggaccgagagggccucggcugugugaggacuagaggcggccgaggcccgggccgguucccccga

SEQ ID NO: 2013 - RNA, 69 nt, Homo sapiens
gaacgauagcagcaugaaccugucucacugcagaauuauuuugagacaggcuuaugcugcuauccuuca

SEQ ID NO: 2014 - RNA, 115 nt, Homo sapiens
uagcuggguggauguguucuuuugaaggauagcagcauaagccugucucaaaauaauucugcagugagacagguucaugcugcuaucguuccaaagaggaaggguaaucacuguc

SEQ ID NO: 2015 - RNA, 75 nt, Homo sapiens
gucagaggggggaugugcaugcugguuggggugggcugccuguggaccaaucagcgugcacuuccccacccugaa

SEQ ID NO: 2016 - RNA, 87 nt, Homo sapiens
ugcggugacaucagggcccagucccugcugucaugccccaggugacgugcugggcugacagcagggcuggccgcuaacgucacuguc

SEQ ID NO: 2017 - RNA, 70 nt, Homo sapiens
ccagaaguggucugcaaagagaugacugugaauccaagauccacaucagcucugugcugccuacaucuga

SEQ ID NO: 2018 - RNA, 90 nt, Homo sapiens
uauucuacugagaguacagaucuuuauauauaugaucauuauauguaugaugagaucauuauauguaugaucuggacacccaguagaauc

SEQ ID NO: 2019 - RNA, 78 nt, Homo sapiens
augacaggccaucagcaguccaaugaagacaugaagacccaaugucuucauuggacugcugauggcccgucacuggga

SEQ ID NO: 2020 - RNA, 56 nt, Homo sapiens
cgaccgcacccgcccgaagcugggucaaggagcccagcaggacgggagcgcggcgc

SEQ ID NO: 2021 - RNA, 47 nt, Homo sapiens
gccuaggaguccuuggucaguggggacauggagaaggcuucugagga

SEQ ID NO: 2022 - RNA, 51 nt, Homo sapiens
acagaccccggggagcccggcggugaagcuccugguauccugggugucuga

SEQ ID NO: 2023 - RNA, 71 nt, Homo sapiens
ugagaauguggaaggagguugccggacgcugcuggcugccuuccagcguccacuucccuuucucucucucc

SEQ ID NO: 2024 - RNA, 60 nt, Homo sapiens
ugugaaugacccccuuccagagccaaaaucaccagggauggaggaggggucuuggguacu

SEQ ID NO: 2025 - RNA, 59 nt, Homo sapiens
aacugggucccagucuucacaguugguuucugacacguggaccuggcugggacgaugug

SEQ ID NO: 2026 - RNA, 88 nt, Homo sapiens
augugguagauauaugcacgauauauauacugcccugcuuuuauacauacauacauacauaccuauaucgugcauauaucuaccacau

SEQ ID NO: 2027 - RNA, 88 nt, Homo sapiens
augugguagauauaugcacgauauagguauguauguauguauguauaaaagcagggcaguauauauaucgugcauauaucuaccacau

SEQ ID NO: 2028 - RNA, 70 nt, Homo sapiens
ugagccgagcugagcuuagcugggcugagcuaaccagggcugggcugagcugggcugagcugagcugagc

SEQ ID NO: 2029 - RNA, 78 nt, Homo sapiens
gagcuuggaugagcugggcugaacugggcuggguugagcugggcugggcugaguugagccaggcugaucugggcugag

SEQ ID NO: 2030 - RNA, 60 nt, Homo sapiens
ugagcugggcucugcugugcugugcugagcagggcugagcugaacugggcugagcugggc

SEQ ID NO: 2031 - RNA, 55 nt, Homo sapiens
aagcugcauggaccaggacuuggcaccuuuggccuuaguccugccuguagguuua

SEQ ID NO: 2032 - RNA, 61 nt, Homo sapiens
gagggcagcguggguguggcggaggcaggcgugaccguuugccgcccucucgcugcucuag

SEQ ID NO: 2033 - RNA, 79 nt, Homo sapiens
uggcaagucuccgcauaugccuggcuagcuccuccacaaaugcguguggaggagcuagccaggcauaugcagagcguca

SEQ ID NO: 2034 - RNA, 54 nt, Homo sapiens
ggacaagggcggcgcgaccggcccggggcucuugggcggccgcguuuccccucc

SEQ ID NO: 2035 - RNA, 79 nt, Homo sapiens
ccgggacuuuguggguucugaccccacuuggaucacgccgacaacacuggucuugaagucagaacccgcaaaguccugg

SEQ ID NO: 2036 - RNA, 80 nt, Homo sapiens
uagauucagaacucguguucaaagccuuuagcccagcaaugggagagugcuaaaggcuucaagcacgaguucugaaucua

SEQ ID NO: 2037 - RNA, 84 nt, Homo sapiens
cccuuacuuggaucugcaauuaguauuuuaaucauagauuguauuuaguuaguuuuuaauacuaacugcagauucaagugaggg

SEQ ID NO: 2038 - RNA, 68 nt, Homo sapiens
gacucggcugcgguggacaaguccggcuccagaaccuggacaccgcucagccggccgcggcagggguc

SEQ ID NO: 2039 - RNA, 69 nt, Homo sapiens
uugcuaaguaggcugagauugaugucagguuauccccaagcauaaccucacucucaccuugcuuugcag

SEQ ID NO: 2040 - RNA, 90 nt, Homo sapiens
cugugggcugggccagggagcagcuggugggugggaaguaagaucugaccuggacuccaucccacccacccccuguuuccuggcccacag

SEQ ID NO: 2041 - RNA, 66 nt, Homo sapiens
ggggggcagggggcagagggcaucagaggacagccgccuggugcccaugccauacuuuugccucag

SEQ ID NO: 2042 - RNA, 82 nt, Homo sapiens
cacaacugcauggcaucguccccugguggcuguggccuagggcaagccacaaagccacucagugaugaugccagcaguugug

SEQ ID NO: 2043 - RNA, 78 nt, Homo sapiens
gugugcccuagcauuuauaaucauguguucauucacaugaucauaaguggacacaugaccauaaaugcuaaagcacac

SEQ ID NO: 2044 - RNA, 84 nt, Homo sapiens
gcggcggugcucugccucuuucuccauccacccugguccagguccacagcaguggagagagaaaagagacagaaggauggccgu

SEQ ID NO: 2045 - RNA, 77 nt, Homo sapiens
ugauagggaaaccaggcaagaaauauugucuccucaaguugcgacgagacaguaguucuugccugguuucucuauca

SEQ ID NO: 2046 - RNA, 63 nt, Homo sapiens
acugggaagaggagcugagggacauugcggagagggucucacauugucccucucccuucccag

SEQ ID NO: 2047 - RNA, 80 nt, Homo sapiens
ccaggagggugaagauggugcugugcugaggaaaggggaugcagagcccugcccagcaccaccaccuccuaugcuccugg

SEQ ID NO: 2048 - RNA, 72 nt, Homo sapiens
ugugggacugcaaaugggagcucagcaccugccugccacccacgcagaccagccccugcucuguucccacag

SEQ ID NO: 2049 - RNA, 64 nt, Homo sapiens
ucugggcgaggggugggcucucagaggggcuggcaguacugcucugaggccugccucuccccag

SEQ ID NO: 2050 - RNA, 76 nt, Homo sapiens
uucuguagagauuaucaggccucuuucuaccuuccaaggcucagaagguagaaugaggccugacauaucugcagga

SEQ ID NO: 2051 - RNA, 76 nt, Homo sapiens; identical to SEQ ID NO: 2050

SEQ ID NO: 2052 - RNA, 73 nt, Homo sapiens
cggcgacggcggggugggugaggucgggccccaagacucgggguuugccgggcgccucaguucaccgcggccg

SEQ ID NO: 2053 - RNA, 78 nt, Homo sapiens
uauuggacgaggggacugguuaauagaacuaacuaaccagaacuauuuuguucuguuaacccauccccucaucuaaua

SEQ ID NO: 2054 - RNA, 83 nt, Homo sapiens
uuguccaauucucugagcaaggcuuaacaccaaaggguuaaggguuugcucuggaguuaaggguugcuuggagaauuggagaa

SEQ ID NO: 2055 - RNA, 76 nt, Homo sapiens
cuggcugguugugggaucuggaggcaucugggguuggaaugugaccccagucuccuuuucccucaucaucugccag

SEQ ID NO: 2056 - RNA, 74 nt, Homo sapiens
ccaagggcacaccggggauggcagagggucgugggaaaguguugacccucgucagguccccggggagccccugg

SEQ ID NO: 2057 - RNA, 75 nt, Homo sapiens
aggcuggcgugggcugagggcaggaggccuguggccggucccaggccuccugcuuccugggcucaggcucgguuu

SEQ ID NO: 2058 - RNA, 53 nt, Homo sapiens
aauguggaaguggucugaggcauauagaguauaugccaagaacacuaccauau

SEQ ID NO: 2059 - RNA, 65 nt, Homo sapiens
gcugcccuucacucagagcaucuacacccacuaccggugaguguggauccuggaggaaucguggc

SEQ ID NO: 2060 - RNA, 81 nt, Homo sapiens
gaaacugcugaagcugccaugucuaagaagaaaacuuuggagaaaaauuuucuucuuagacauggcaacgucaacaguuuc

SEQ ID NO: 2061 - RNA, 73 nt, Homo sapiens
cuguugacguugccaugucuaagaagaaaauuuuucuccaaaguuuucuucuuagacauggcagcuucagcag

SEQ ID NO: 2062 - RNA, 74 nt, Homo sapiens
acuccuucugcagcucugguggaaaauggagaagacuuuuccuuuccuccaucucccccagggccugguggagu

SEQ ID NO: 2063 - RNA, 75 nt, Homo sapiens
uuuacucugaacuagcucuguggauccugacagacagccugauagacaggauccacagagcuaguccagaguaaa

SEQ ID NO: 2064 - RNA, 67 nt, Homo sapiens
ucuauuuagccaauuguccaucuuuagcuauucugaaugccuaaagauagacaauuggcuaaauaga

SEQ ID NO: 2065 - RNA, 81 nt, Homo sapiens
cacaauuucuauuuagccaauugucuaucuuuaggcauucagaauagcuaaagauggacaauuggcuaaauagacacugug

SEQ ID NO: 2066 - RNA, 76 nt, Homo sapiens
cugugguggagcugagcuccauggacgugcaguggcaucugucauugcugccuuccuggagcucaggcccuugcag

SEQ ID NO: 2067 - RNA, 71 nt, Homo sapiens
guugggggcuggggugcccacuccgcaaguuaucacugagcgacuuccggucugugagccccguccuccgc

SEQ ID NO: 2068 - RNA, 79 nt, Homo sapiens
cucgaggugcugggggacgcgugagcgcgagccgcuuccucacggcucggccgcggcgcguagcccccgccacaucggg

SEQ ID NO: 2069 - RNA, 79 nt, Homo sapiens
aucacuuaaauacaugucagauuguaugccuacaaaaucccuccagacuggcauacaaucugacauguauuuaagagau

SEQ ID NO: 2070 - RNA, 81 nt, Homo sapiens
ugucuaaauugcaugucagauuguaauucccaggcccuuccuccaauacugggaauuacaauuugacaugcaauuuagaca

SEQ ID NO: 2071 - RNA, 66 nt, Homo sapiens
ugacuggggagcagaaggagaacccaagaaaagcugacuuggaggucccuccuucuguccccacag

SEQ ID NO: 2072 - RNA, 70 nt, Homo sapiens
agggaaaaaaaaaaggauuugucuuguagccaggauauuguuuuaaagaaaauccuuuuuguuuuuccag

SEQ ID NO: 2073 - RNA, 62 nt, Homo sapiens
gccucccuucacuuccuggccauccaggcaucugugucuguguccgggaaguggaggagggc

SEQ ID NO: 2074 - RNA, 75 nt, Homo sapiens
cucuaggaagcgaccaugauguaacuucacagacucuccaaaagucugaaguuacaucauggucgcuuccuagag

SEQ ID NO: 2075 - RNA, 73 nt, Homo sapiens
uauuuuaagaccgaagacugugcgcuaaucucuuagcacugaagauuagugcauagucuuuggucucaaaaua

SEQ ID NO: 2076 - RNA, 81 nt, Homo sapiens
ggcugcuucucgccucuguccagcuguguggccuuggacaagccucuugguuacacagcuggacagaggcacgaaacagcc

SEQ ID NO: 2077 - RNA, 59 nt, Homo sapiens
guccaggcaggagccggacuggaccucagggaagaggcugacccggccccucuugcggc

SEQ ID NO: 2078 - RNA, 87 nt, Homo sapiens
cccaggcgcccgcucccgacccacgccgcgccgccgggucccuccuccccggagaggcugggcucgggacgcgcggcucagcucggg

SEQ ID NO: 2079 - RNA, 77 nt, Homo sapiens
caugagaaauccugcuggucaaccauagcccuggucagacucuccggggcugugauugaccagcaggacuucucaug

SEQ ID NO: 2080 - RNA, 72 nt, Homo sapiens
ugaaugaaagagccaguggugagacagugaguugauuacuucucacuguuucaccacuggcucuuugguuca

SEQ ID NO: 2081 - RNA, 80 nt, Homo sapiens
gcaaagcagcaauuguucuuuggucuuucagccaugaccugaccuucugucugugagaccaaagaacuacuuugcuuggc

SEQ ID NO: 2082 - RNA, 74 nt, Homo sapiens
ggaaaaaacaagguauuguucagacuuaugauuuuuggggucaaagauucugagcaauaaccuauuaaaaaacc

SEQ ID NO: 2083 - RNA, 75 nt, Homo sapiens
gucuuuuuucugugauagagauucuuugcuuuguuagaaacaaaaagcaaagaaucucuaucacagaaaaaagau

SEQ ID NO: 2084 - RNA, 77 nt, Homo sapiens
uaucuuuuuucugugauagagauucuuugcuuuuuguuucuaacaaagcaaagaaucucuaucacagaaaaaagacg

SEQ ID NO: 2085 - RNA, 66 nt, Homo sapiens
uauaagaacucuugcagucuuagauguuauaaaaauauauaucugaauuguaagaguuguuagcac

SEQ ID NO: 2086 - RNA, 72 nt, Homo sapiens
ggcaacgggaaugcaggcuguaucugcagggcauugugcuaacaggugcaggcugcagaccugucacaggcc

SEQ ID NO: 2087 - RNA, 80 nt, Homo sapiens
ugccccuggucugaguuccuggagccuggucugucacuggggaaguccagagcuccaaggcucagugcccaggggacgca

SEQ ID NO: 2088 - RNA, 81 nt, Homo sapiens
gacacgcaagacgaggcgggccuggaggugcaccaguucuggccgcugguggagauccagugcucgcccgaucucaaguuc

SEQ ID NO: 2089 - RNA, 82 nt, Homo sapiens
gcaccagggguaccucucuacugacuugcaacauacauuugucuugguguguugcaagucgguggagacguacccuuggugc

SEQ ID NO: 2090 - RNA, 69 nt, Homo sapiens
uagcccagggcuuggaguggggcaagguuguuggugauauggcuuccucucccuuccugcccuggcuag

SEQ ID NO: 2091 - RNA, 76 nt, Homo sapiens
ggcuuccuguaucugcugggcuuucugguguuggcagcccaagaugacacccugggcccagcaggagccagaagcc

SEQ ID NO: 2092 - RNA, 80 nt, Homo sapiens
accugaggagccagcccuccucccgcacccaaacuuggagcacuugaccuuuggcuguuggagggggcaggcucgcgggu

SEQ ID NO: 2093 - RNA, 83 nt, Homo sapiens
gucuacucccagggugccaagcuguuucguguucccucccuaggggaucccagguaggggcagcagaggaccugggccuggac

SEQ ID NO: 2094 - RNA, 70 nt, Homo sapiens
gguuucuccuugaggagacauggugggggccggucaggcagcccaugccauguguccucauggagaggcc

SEQ ID NO: 2095 - RNA, 60 nt, Homo sapiens
gagcaggcgaggcugggcugaacccgugggugaggagugcagcccagcugaggccucugc

SEQ ID NO: 2096 - RNA, 85 nt, Homo sapiens
ggagcacucccagguccuccaggccaugagcugcggcccugaugucucuacuccagccacggacugagagugcauaggagugucc

SEQ ID NO: 2097 - RNA, 63 nt, Homo sapiens
guuuuacuugauacccacacugccugggugggacacucaggcaguguggguaucagauaaaac

SEQ ID NO: 2098 - RNA, 75 nt, Homo sapiens
guuuaaagaauacugugaauuucacugucacaaauucaaauaaagugagaguggaauucacaguauuuaaggaau

SEQ ID NO: 2099 - RNA, 80 nt, Homo sapiens
caaauacauagguguuauccuauccauuugccucucucagaaaauagagucaaauggacaggauaacaccuauguauuug

SEQ ID NO: 2100 - RNA, 74 nt, Homo sapiens
ccugcaggaggcagugggcgagcaggcggggcagcccaaugccaugggccugaucucaccgcugccuccuuccc

SEQ ID NO: 2101 - RNA, 70 nt, Homo sapiens
caaagccacugcaagacggauacugucaucuauuccagaagaugacaauguccauuuugcaguggcuuug

SEQ ID NO: 2102 - RNA, 78 nt, Homo sapiens
gggcccagaagggggcgcagucacugacgugaagggaccacaucccgcuucaugucagugacuccugccccuuggucu

SEQ ID NO: 2103 - RNA, 80 nt, Homo sapiens
ugcuucuccuggggucuuccucuacauuuccaccuagacgggccugggucaaaauguagaggaagaccccagaaggagca

SEQ ID NO: 2104 - RNA, 74 nt, Homo sapiens
agcaauuggagaagauugcagaguaaguuccugauuaagaaauggaauuuacucugcaaucuucuccaauugcu

SEQ ID NO: 2105 - RNA, 74 nt, Homo sapiens
ucagugaggucuggggaugaggacaguguguccugaaauucacaggacugacuccucaccccagugcacgagga

SEQ ID NO: 2106 - RNA, 63 nt, Homo sapiens
ccuuggccaccacaccuaccccuugugaaugucgggcaaugggugaugggugugguguccaca

SEQ ID NO: 2107 - RNA, 79 nt, Homo sapiens
uuaugcauauuagcaauacaguacaaauauaguguguuugauuugcacuguaguuguauuguauugccacucuguauaa

SEQ ID NO: 2108 - RNA, 75 nt, Homo sapiens
cuuauccuagacacuaggcaugugagugauugucuuccucacucaaucagucacauaucuagugucuagaaugag

SEQ ID NO: 2109 - RNA, 71 nt, Homo sapiens
cucacaagaucaaucacuugguaauugcugugauaacaacucagcaauuaccaagugauugguuuugugag

SEQ ID NO: 2110 - RNA, 82 nt, Homo sapiens
gcuacggggagcggggaggaagugggcgcugcuucugcguuaucuggaaggagcagcccacuccuguccugggcucuguggu

SEQ ID NO: 2111 - RNA, 80 nt, Homo sapiens
gguuccggagccccggcgcgggcggguucugggguguagacgcugcuggccagcccgccccagccgagguucucggcacc

SEQ ID NO: 2112 - RNA, 67 nt, Homo sapiens
uuuaggagagagaugccgccuugcuccuugaacaggaggagcaaggcggcaucucucugauacuaaa

SEQ ID NO: 2113 - RNA, 72 nt, Homo sapiens
cugcuucaacaacagugacuugcucuccaaugguauccagugauucguugaagaggaggugcucuguagcag

SEQ ID NO: 2114 - RNA, 56 nt, Homo sapiens
gaccgaguggggugagggcaggugguucuucccgaagcagcucucgccucuucguc

SEQ ID NO: 2115 - RNA, 70 nt, Homo sapiens
aaaugugcaucaggccagaagacaugagcccuuuggaaaggucucgugucuucuggcuugaugcacauuu

SEQ ID NO: 2116 - RNA, 82 nt, Homo sapiens
gacaggauuccaguacaggucucucauuuccuucaugauuaggaauacuacuuugaaaugagagaccuguacuguaucuguu

SEQ ID NO: 2117 - RNA, 75 nt, Homo sapiens
guccccauuuuucucccacuaccaggcucccauaagggucgaaugggauccagacagugggagaaaaauggggac

SEQ ID NO: 2118 - RNA, 77 nt, Homo sapiens
auuuuggccaacucugaccccuuagguugaugucagaaugagguguaccaaccuagguggucagaguuggccaaaau

SEQ ID NO: 2119 - RNA, 79 nt, Homo sapiens
ggggaaugaaaguuggcugcaguuaagguggcuaaucagcugauggugccaccuuaacugcagccaauucuaauucccc

SEQ ID NO: 2120 - RNA, 84 nt, Homo sapiens
cauacuuugucuccauguuuccuucccccuucuguauacauguauacaggaggaagggggaaggaaacauggagacaaagugug

SEQ ID NO: 2121 - RNA, 72 nt, Homo sapiens
ggcaguguuuaggccacagccacccauguguagggguggcuacacauggguggcuguggccuaaacacugcc

SEQ ID NO: 2122 - RNA, 51 nt, Homo sapiens
agcuguaccugaaaccaagcaccuguuugugacuuggcuucaguuacuagc

SEQ ID NO: 2123 - RNA, 84 nt, Homo sapiens
acaaugaugacuuguauguuauagauuugugauuacauuaaaacuuaaaauuucacaaaucuauaauaugcaggucaucacugu

SEQ ID NO: 2124 - RNA, 76 nt, Homo sapiens
aagccuggcauauuugguauaacuuaagcaccagguaaaaucuggugcuuaaguuguaccaaguauagccaaguuu

SEQ ID NO: 2125 - RNA, 89 nt, Homo sapiens
gggccuggucauggucaagccagguuccaucaagccccaccagaagguggaggcccaggugagggcuccaggugacggugggcaggguu

SEQ ID NO: 2126 - RNA, 60 nt, Homo sapiens
ggcaggagggcugugccagguuggcugggccaggccugaccugccagcaccucccugcag

SEQ ID NO: 2127 - RNA, 81 nt, Homo sapiens
aguuggugggggagccaugagauaagagcaccuccuagagaauguugaacuaaaggugcccucucuggcuccuccccaaag

SEQ ID NO: 2128 - RNA, 89 nt, Homo sapiens
acgcaaaaugaacugaaccaggagugagcuucguguacauuaucuauuagaaaaugaaguaccuucugguucagcuagucccugugcgu

SEQ ID NO: 2129 - RNA, 90 nt, Homo sapiens
gugucucucuggagacccugcagccuucccacccaccagggagcuuuccaugggcuguggggaaggcgucagugucgggugagggaacac

SEQ ID NO: 2130 - RNA, 58 nt, Homo sapiens
agggccagaggagccuggaguggucgggucgacugaacccagguucccucuggccgca

SEQ ID NO: 2131 - RNA, 55 nt, Homo sapiens
aaucugccagcuuccacaguggcagauuuucccauagugggaagcuggcagauuc

SEQ ID NO: 2132 - RNA, 67 nt, Homo sapiens
gugggaggggagaggcagcaagcacacagggccugggacuagcaugcugaccucccuccugccccag

SEQ ID NO: 2133 - RNA, 72 nt, Homo sapiens
ucuguuuccucauuuaucuguugggaagcuaacugugaccuuagcgucccagcagauaaaugaggaaacaga

SEQ ID NO: 2134 - RNA, 76 nt, Homo sapiens
cgcaggccucuggcggagcccauuccaugccagaugcugagcgauggcuggugugugcugcuccacaggccuggug

SEQ ID NO: 2135 - RNA, 70 nt, Homo sapiens
cccugccagugcugggggccacaugagugugcagucauccacacacaaguggcccccaacacuggcaggg

SEQ ID NO: 2136 - RNA, 76 nt, Homo sapiens
gagggagcuguagagcagggagcaggaagcuguguguguccagcccugaccuguccuguucugcccccagccccuc

SEQ ID NO: 2137 - RNA, 76 nt, Homo sapiens
ggucgcuuaaaucccaaugcuagacccgguggcaaucaaggucuagccaccaggucuagcauugggauuuaagccc

SEQ ID NO: 2138 - RNA, 70 nt, Homo sapiens
cucgggcccgaccgcgccggcccgcaccucccggcccggagcugcgggcugcggucagggcgaucccggg

SEQ ID NO: 2139 - RNA, 69 nt, Homo sapiens
ugcagugccuaauuugaacaccuucgguauucaucaaaaauaccaaaggugcucaaauuagacauugca

SEQ ID NO: 2140 - RNA, 47 nt, Homo sapiens
aggcagguuaucugggcugccaucucccacuggcugcuugccugccu

SEQ ID NO: 2141 - RNA, 81 nt, Homo sapiens
cugcacaggaugcgaggaugcugacagugccucacagccgcacaggaccgaggaugcugacggugccucacagccacacag

SEQ ID NO: 2142 - RNA, 87 nt, Homo sapiens
ggucgcauuucuccuucuuaccagcgcguuuucaguuucauagggaagccuuuccaugaaacuggagcgccuggaggagaaggggcc

SEQ ID NO: 2143 - RNA, 74 nt, Homo sapiens
gggaggaagaagggaggaggagcggaggggcccuugucuucccagagccucucccuuccuccccucccccuccc

SEQ ID NO: 2144 - RNA, 63 nt, Homo sapiens
gccaaggacugauccucucgggcagggagucagaggggaccgcccgagaggauccgucccugc

SEQ ID NO: 2145 - RNA, 90 nt, Homo sapiens
cgggcggggcggguccggccgccuccgagcccggccggcagcccccggccuuaaagcgcgggcuguccggaggggucggcuuucccaccg

SEQ ID NO: 2146 - RNA, 85 nt, Homo sapiens
ucaggcaaagggauauuuacagauacuuuuuaaaauuuguuugaguugaggcagauuaaauaucuguauucuccuuugccugcag

SEQ ID NO: 2147 - RNA, 69 nt, Homo sapiens
gcuggccggaugggacaggaggcaugaaugagccaucuuuccaaugccuuucugucuuuucugguccag

SEQ ID NO: 2148 - RNA, 82 nt, Homo sapiens
guaaucacaucuaaagacuagacuucgcuaugaccaggccauaguaaacaucauaguaugucuagucuuuagguuugauuac

SEQ ID NO: 2149 - RNA, 62 nt, Homo sapiens
gugaguggggcucccgggacggcgcccgcccuggcccuggcccggcgacgucucacgguccc

SEQ ID NO: 2150 - RNA, 71 nt, Homo sapiens
gugucugugccggucccaggagaaccugcagaggcaucgggucagcggugcuccugcgggccgacacucac

SEQ ID NO: 2151 - RNA, 54 nt, Homo sapiens
agggaaggaggcuuggucuuagcacggggucuaaggcccgggcuuuccucccag

SEQ ID NO: 2152 - RNA, 82 nt, Homo sapiens
uggcuggcugagguuuggggaggauuugcuggugcuagagaggaaagcagacccuacccaaccccacgcccuacuacagcca

SEQ ID NO: 2153 - RNA, 61 nt, Homo sapiens
ccugcggggacaggccagggcaucuaggcugugcacagugacgccccuccugcccccacag

SEQ ID NO: 2154 - RNA, 56 nt, Homo sapiens
cgcucgggcggaggugguugagugccgacuggcgccugacccacccccucccgcag

SEQ ID NO: 2155 - RNA, 74 nt, Homo sapiens
cccggagccagaggacccguagcugcuagaagggcagggguguggcuucugggggcuggucuucagcucuggcg

SEQ ID NO: 2156 - RNA, 72 nt, Homo sapiens
agugucuccuuguggaucucaaggaugugcuuccacauagcagcauguucuucagauggacaaggagacacu

SEQ ID NO: 2157 - RNA, 83 nt, Homo sapiens
auaucuacacaaggccaaaggaagagaacagauauauccacaguacacuuggcuguucucuuucuuuagccuuguguagauau

SEQ ID NO: 2158 - RNA, 89 nt, Homo sapiens
acgcgccugaugcggaccuggguuagcggagugaggcccaguggucaccgccgcccuccgcagguccagguugccgugcgcaugugccu

SEQ ID NO: 2159 - RNA, 72 nt, Homo sapiens
agauucagcuuucccuucagagccuggcuuuggcaucuaugaaagccaggcucugaagggaaaguugaaucu

SEQ ID NO: 2160 - RNA, 78 nt, Homo sapiens
gggauaaaaugcagggaggcgcucacucucugcugccgauucugcaccagagaugguugccuuccuauauuuuguguc

SEQ ID NO: 2161 - RNA, 77 nt, Homo sapiens
uuccagcccgaggccucugugacgucacggugucugcgggaggagaccaugacgucacagaggcuucgcgcucugag

SEQ ID NO: 2162 - RNA, 71 nt, Homo sapiens
ggugagugggagccgguggggcuggaguaagggcacgcccggggcugccccaccugcugaccacccucccc

SEQ ID NO: 2163 - RNA, 83 nt, Homo sapiens
cauuuaggacuagauguuggaauuagacagaaaaaaguuagacacaaaaaauugugucuaauuccaacaucuaguccuaaaug

SEQ ID NO: 2164 - RNA, 80 nt, Homo sapiens
gccaugguguuuagauugaacaugaaguuagaauucuuaaguaucaaaacuaaauucauguucaaucuaaaccccauggc

SEQ ID NO: 2165 - RNA, 82 nt, Homo sapiens
ggacaaggugugcaugccugacccguugucagaccuggaaaaagggccggcugugggcagggagggcaugcgcacuuugucc

SEQ ID NO: 2166 - RNA, 75 nt, Homo sapiens
cugauaccccaaaucuugaucagaagccuugaucagaagcuaggaaggcuucugaucaagauuuguggugucaag

SEQ ID NO: 2167 - RNA, 92 nt, Homo sapiens
ccugucccuccugcccugcgccugcccagcccuccugcucuggugacugaggaccgccaggcaggggcuggugcugggcggggggcggcggg

SEQ ID NO: 2168 - RNA, 88 nt, Homo sapiens
ucuuccccauggauguggaaggaguuaucugucaccagucagauaacugucaccagucaguuaacuccuuucacacccauggggaaga

SEQ ID NO: 2169 - RNA, 77 nt, Homo sapiens
uggugauuuugaacguagcuauccaccacucagccuggaaaaagcugagugauugauagcuauguucaaaaucacca

SEQ ID NO: 2170 - RNA, 76 nt, Homo sapiens
cugaagcuccuucugaaagagcaguugguguuuauuuuuuacuaaauagcaauugcucuuuuggaaggaacuugag

SEQ ID NO: 2171 - RNA, 78 nt, Homo sapiens
acaugggcccgcgggcgcuccuggccgccgcccgacuucggggccagccgggggcagagcgcgcgggagcccgagcgu

SEQ ID NO: 2172 - RNA, 74 nt, Homo sapiens
aaacuuugauucucucuggaucccauggauaugggaacugugauguccaggagauccagagagaaucagaguuu

SEQ ID NO: 2173 - RNA, 77 nt, Homo sapiens
gaggagaggugggauggagagaagguaugagcuaaaaauccccaagcucugccauccucccuccccuacuucucccc

SEQ ID NO: 2174 - RNA, 58 nt, Homo sapiens
gaguuauggggucaucuauccuucccuuggaaaaugaucugagaugacacuguagcuc

SEQ ID NO: 2175 - RNA, 74 nt, Homo sapiens
gcucuagccuaauuuuagaucuggucugcuucaguuucacuccaagcagacuugaccuacaauuagccuagagc

SEQ ID NO: 2176 - RNA, 74 nt, Homo sapiens; identical to SEQ ID NO: 2175

SEQ ID NO: 2177 - RNA, 78 nt, Homo sapiens
gugauugccucugaucaggcaaaauugcagacugucuucccaaauagccugcaacuuugccugaucagaggcagucac

SEQ ID NO: 2178 - RNA, 78 nt, Homo sapiens
ugcuccccagccuuucuaugcuccuguucugcuuuauuucaucaaagcagaacaggagcauagaaaggcuggggagca

SEQ ID NO: 2179 - RNA, 78 nt, Homo sapiens
ugcuccccagccuuucuaugcuccuguucugcuuugaugaaauaaagcagaacaggagcauagaaaggcuggggagca

SEQ ID NO: 2180 - RNA, 76 nt, Homo sapiens
uauauuguugucugguauguaguagguaauaacugacaaacagacaauugccuaacaugugccagaaaacaacaua

SEQ ID NO: 2181 - RNA, 75 nt, Homo sapiens
auuaagcuuuuaauuuuuuguuucggucacucuugauagcagacauugacugaaacaaaaaauuaaaagcuuuau

SEQ ID NO: 2182 - RNA, 80 nt, Homo sapiens
cuauaugcaguggaccaggauggcaagggcucuccugaaaggacaguagagcccuugccauccugguccacugcauauag

SEQ ID NO: 2183 - RNA, 80 nt, Homo sapiens
cuauaugcaguggaccaggauggcaagggcucuacuguccuuucaggagagcccuugccauccugguccacugcauauag

SEQ ID NO: 2184 - RNA, 86 nt, Homo sapiens
uagaauauuucggcauucuagaugagagauauauauauaccucauauguauaugguauaccucaucuagaaugcuguaauauucua

SEQ ID NO: 2185 - RNA, 80 nt, Homo sapiens
ucacauguccaauucuguaaaggaagaagagguaagaagaagugaagcccucuucuuccuuugcagaguugaauaugugg

SEQ ID NO: 2186 - RNA, 83 nt, Homo sapiens
uaaaugucuuacugcuuuuacuguucccuccuagaguccauucuuuacucuaggagggaauaguaaaagcaguaagacauuua

SEQ ID NO: 2187 - RNA, 81 nt, Homo sapiens
ggccagugccagggggucaggcucaaggaccagcccaaaggccaggccugacccuugagccugaucccuagcacugauccc

SEQ ID NO: 2188 - RNA, 76 nt, Homo sapiens
aggugcacgcucuagcggggauuccaauauugggccaauucccccaauguuggaauccucgcuagagcgugcacuu

SEQ ID NO: 2189 - RNA, 79 nt, Homo sapiens
auugcccaguucuggauaugaagacaaucaagaaaagauuugguguucuugauugucuucauaucuagaacugggcagu

SEQ ID NO: 2190 - RNA, 82 nt, Homo sapiens
gggaaagcggagggcgcgcccagcucccgggcugauugcgcuaacaguggccccgguguuggggcgcgucugccgcugcccc

SEQ ID NO: 2191 - RNA, 77 nt, Homo sapiens
ugacugggcugaggagaugcugggacugagagugucaugguggagccuccgucccugcucauccucuccgcauguug

SEQ ID NO: 2192 - RNA, 73 nt, Homo sapiens
guagguggggacgcggcggcgcugcuccuccgcugccgccgggagagucggcgacgccgccagcuccgcgcgc

SEQ ID NO: 2193 - RNA, 80 nt, Homo sapiens
gggcauggccugagaccaggacuggaugcaccacucucccugugaugaggugaagccagcucuggucugggccauuucac

SEQ ID NO: 2194 - RNA, 84 nt, Homo sapiens
cgguccagacguggcggggguggcggcggcaucccggacggccugugagggaugcgccgcccacugccccgcgccgccugaccg

SEQ ID NO: 2195 - RNA, 80 nt, Homo sapiens
aaugaaggauuacggaccagcuaagggaggcauuaggauccuuauucuugccucccuuaguuggucccuaauccuucguu

SEQ ID NO: 2196 - RNA, 82 nt, Homo sapiens
caugcuacguauguauacaccugauauguguauguguaaauacauauccacacacauagcagguguauauauagguagccug

SEQ ID NO: 2197 - RNA, 79 nt, Homo sapiens
caaugugacaucgcuuuaccauucauguucacugaaagguagauuuuaaaaacaugaaugguaaagcgaugucacauug

SEQ ID NO: 2198 - RNA, 84 nt, Homo sapiens
uaagaacuggauaugaugacugaaauaagcuccauaucaaugagaauuucaaugggauuaugugcagucaauguccaguaauua

SEQ ID NO: 2199 - RNA, 74 nt, Homo sapiens
gcagcccggugagcgcucgcuggccuggcagugcgucggaagaacagggcggguggggccgcgcacaucucugc

SEQ ID NO: 2200 - RNA, 87 nt, Homo sapiens
uuucuccucgcugcccgcacauccugcuccacagggcagagggaggccaagaagaccucugcacugugaguuggcuggcuggaggaa

SEQ ID NO: 2201 - RNA, 77 nt, Homo sapiens
uuuuaacaucuggcuaucucacgagacuguauguccuaacagugcuuguagucucaugagauagccagauguuaaaa

SEQ ID NO: 2202 - RNA, 89 nt, Homo sapiens
ugauauggaagaaauccagaaguggcuaauaauauugacacuauaacaauaaugucaauauuauuagccacuucuggauuuaugaauca

SEQ ID NO: 2203 - RNA, 81 nt, Homo sapiens
uaaauuugugucuauacucugucacuuuacuuuuggccucaagucauugcaguaaaguggcagaguauagacacaaauuua

SEQ ID NO: 2204 - RNA, 71 nt, Homo sapiens
gacucagaagacagagugccacuuacugaaagguuuuuucucucaguaaguggcacucugucuucugaguu

SEQ ID NO: 2205 - RNA, 75 nt, Homo sapiens
aaguacaacuucgguauacuuugugaauuggcuuuuacaaaagaccaacucacgaaguauaccgaagucauacuu

SEQ ID NO: 2206 - RNA, 74 nt, Homo sapiens
acugcuaauaucuaaaugcagcaugccaguccugagaugcagggacuggcaugcugcauuuauauauuagcagu

SEQ ID NO: 2207 - RNA, 80 nt, Homo sapiens
ggagaaaggaguggaccgaggaaggaaggaaggcaaggcugucuguccauccguccgucuguccaccuaccugucagucc

SEQ ID NO: 2208 - RNA, 82 nt, Homo sapiens
uugaggcuugguuuucuuauguguaaaauguaauaacauuucuuauguuuaaaacacuuuacacaagaaaaccaaggcucaa

SEQ ID NO: 2209 - RNA, 80 nt, Homo sapiens
cugacuggcuuguauggagguucuagaccauguuaguguucaagucuacauggauggaaaccuucaagcaggccaagcag

SEQ ID NO: 2210 - RNA, 74 nt, Homo sapiens
agugggauuuaacauaauaguguggauugaaucacacacacauuucaacccacacuaugauguuaaaucccauu

SEQ ID NO: 2211 - RNA, 73 nt, Homo sapiens
ucaguguauuuggacgguaagguuaagcaaggugcgucguaucuugcuuaaccuugcccucgaaauacacuga

SEQ ID NO: 2212 - RNA, 91 nt, Homo sapiens
auagaaaauaaaacacauacugcuguauugucagguagugauaggauuuaucacuaccugacaauacaguauguguuuguuuuauauauuu

SEQ ID NO: 2213 - RNA, 103 nt, Homo sapiens
cugaagaguagaguguguggucccaguucagaaguguuccugaguaacuugugcuuauaacucaggacacuucugaacuuggaccauacaggucucccugcuu

SEQ ID NO: 2214 - RNA, 100 nt, Homo sapiens
agcucagggcggcugcgcagagggcuggacucagcggcggagcuggcugcuggccucaguucugccucuguccagguccuugugacccgcccgcucuccu

SEQ ID NO: 2215 - RNA, 97 nt, Homo sapiens
ucuuccucucuguccucuggaauuugguuucugaggcacuuaguaggugauagcaugacugacugccucacugaccacuuccagaugaggguuacuc

SEQ ID NO: 2216 - RNA, 99 nt, Homo sapiens
augaguuugcuuugugucauccucacaacaaccuugcaggguagagaugauuuuuccuacuuuucuagguuguugggggcuggggcagggggaacagag

SEQ ID NO: 2217 - RNA, 107 nt, Homo sapiens
ggcacuugcuuggggguuagugaggacagggcaaauucacgagauuggguugugcagaggcugacacuuggauuuuccugggccucaggacuuccuuucagacaugg

SEQ ID NO: 2218 - RNA, 110 nt, Homo sapiens
aaccauuagggggcugugguuugccagggcaggagguggaagggagccccauuuacagugguaacuuccuuucccuuuccauccuggcaggcuucagagaacuuuaccag

SEQ ID NO: 2219 - RNA, 95 nt, Homo sapiens
gguaaaccuuggugacuaauuagagucuggcugauaugguuugacacagagcuaaaucauaugaaccaaacucuaauuagucaauaauuucuguu

SEQ ID NO: 2220 - RNA, 94 nt, Homo sapiens
gggcugaccccuagggucaggugaggcccuuggggcacaguggugccaucuccccugugcucccagggccucgccugucccuugaggucggccc

SEQ ID NO: 2221 - RNA, 100 nt, Homo sapiens
gaccagaaguguuuuggauuuuggacuuuuucagauuuggggauauuugcauuauacuuauccuaaaucugaaaguccaaaaccugaaaugaccaauaag

SEQ ID NO: 2222 - RNA, 120 nt, Homo sapiens
gauccagggaacccuagagcagggggauggcagagcaaaauucauggccuacagcugccucuugccaaacugcacuggauuuugugucucccauuccccagagcugucugaggugcuuug

SEQ ID NO: 2223 - RNA, 103 nt, Homo sapiens
agaugguauugaguggaugcuguuauauauacagccaugcacucuguaguuuggguacacagugcauggcuguauauauaacacuauccauucaucuuucagc

SEQ ID NO: 2224 - RNA, 100 nt, Homo sapiens
gaagcgcuugccuagacgagacacagugcauaaaaacaacuuuugggggacagguauguuuucuugcagcugcgguuguaaggucuuggcaagacaagca

SEQ ID NO: 2225 - RNA, 76 nt, Homo sapiens
agcuuucuacggguuuguagcuuugcuggcauguuaaguguuguccuacagucgcaagcauaagaaagagaaagua

SEQ ID NO: 2226 - RNA, 84 nt, Homo sapiens
ucuccaggguggccaggcggggccgggccugagggauggaggggagcccaucagggcucagggauuggauggaggugauggggg

SEQ ID NO: 2227 - RNA, 84 nt, Homo sapiens
aaggacuucagugggauuucugaguagcauccuuggaaucugcacucaagggaugcuacucggaaaucccacugaaguccuuuu

SEQ ID NO: 2228 - RNA, 85 nt, Homo sapiens
ucugagguacccggggcagauugguguagggugcaaagccugcccgcccccuaagccuucugcccccaacuccagccugucagga

SEQ ID NO: 2229 - RNA, 93 nt, Homo sapiens
gacuguggcgacggagacgacaagacugugcuggucgcggguugugggguuuaggucaccggcaggggucuggagucccuggagguuagggcu

SEQ ID NO: 2230 - RNA, 88 nt, Homo sapiens
aucccagaucagaugccaaagccaguggggacuggacaacaugaugagcccaaaccaauccacgcugagcuuggcaucugauuuggga

SEQ ID NO: 2231 - RNA, 100 nt, Homo sapiens
cccgccagguccacaugccagagugucaacgugacccagccagccuccuuccugagcuaggaggauuaggaaaugaggcuggcuaggagcacagccaggg

SEQ ID NO: 2232 - RNA, 85 nt, Homo sapiens
aaaagaaaaaaaucagugaaugccuugaaccuaacacacugccuuuuaugugguagguacagugggcucacugaaacauucaacu

SEQ ID NO: 2233 - RNA, 88 nt, Homo sapiens
cugggauuacaggcgugaaccaccgcgcccggccuaacuuuuaagaaacgucggcccgggagcgguggcucacgccuguaaucccagc

SEQ ID NO: 2234 - RNA, 70 nt, Homo sapiens
aguagaggugggguuucaccauguuggucaggcuggucucaaacuccugaccucaggugauccauccacc

SEQ ID NO: 2235 - RNA, 119 nt, Homo sapiens
ccaugaggagcuggcagugggauggccuggggguaggagcguggcuucuggagcuagaccacauggguucagaucccagcggugccucuaacuggccacaggaccuugggcagucagcu

SEQ ID NO: 2236 - RNA, 120 nt, Homo sapiens
ucagccagcuuaugacuugacccucucaccugauuucuaccaaccuuuccucagcugauuucuuucuggggagagauugguagaaaucaggugagagggucaugccauaagcuggcuaac

SEQ ID NO: 2237 - RNA, 76 nt, Homo sapiens
gacuaagggugggaugagggauugaaguggagcaggaaugcgcuuuucuccacugaauccucuuuuccucaggugg

SEQ ID NO: 2238 - RNA, 113 nt, Homo sapiens
gggaggcauggaaauuucucugguuucaauggguacgauuauuguaagcaggauccauucaauaaucggacccauuuaaaccggagauuuuaaaagacaggaauagaauccca

SEQ ID NO: 2239 - RNA, 114 nt, Homo sapiens
ggcccgccuuuuaggggccucgcugucugggcacaggcggauggacaggcuggccucuggaugaccugccaaccgucagagcccagacccacguggccucaguuggggaccagg

SEQ ID NO: 2240 - RNA, 80 nt, Homo sapiens
ggucauacccuggcuccagcccugucacaugguuaauguuccacagccagugacugagcuggagccagggccacugcccc

SEQ ID NO: 2241 - RNA, 120 nt, Homo sapiens
aguuggccaggaccccaagcccccagcacuucauucuugcuguccucuccuggucugggaggauagaagagaggauaggaagaaugaagugcugggcgcuuagggggauccuggccaacu

SEQ ID NO: 2242 - RNA, 92 nt, Homo sapiens
uuaguuccagccuccuggcucaccuggaaccauuucuccugggaagcaugguagccaggagaguggauuccagguggugagggcuugguacu

SEQ ID NO: 2243 - RNA, 109 nt, Homo sapiens
ccuaggaaaggcugcugguaacugggauggggguuggggggagguaagaagucucugacuccuccucuaccucaucccaguuccaucaccugaaguggaccucuuggga

SEQ ID NO: 2244 - RNA, 120 nt, Homo sapiens
auuucuuuggguuaacuuaaacucagcccuucuaggcccauucuuuucacucaggaauuggauaagcuuuucugagggguuuggaaugggauggcagggagagucaccagacaccaugaa

SEQ ID NO: 2245 - RNA, 115 nt, Homo sapiens
gagcaaaaaccagagaacaacaugggagcguuccuaaccccuaaggcaacuggaugggagaccugacccauccaguucucugagggggcucuuguguguucuacaagguuguuca

SEQ ID NO: 2246 - RNA, 115 nt, Homo sapiens
ucugaggagaccugggcugucagaggccagggaaggggacgaggguuggggaacaggugguuagcacuucauccucgucucccucccagguuagaagggccccccucucugaagg

SEQ ID NO: 2247 - RNA, 112 nt, Homo sapiens
uaugggauuccacagacaaugaguaucaauggcacaaacucauucuugaauuuuugccaguucaagaagagacugagucaucgaaugcucuaaaugucacuucaccucaugu

SEQ ID NO: 2248 - RNA, 113 nt, Homo sapiens
aucugacacaaaaugugaaccaagcaauucucaaaggagccucccaggaaauucacuuuaggaaguccuaggaggcuccucugagaguugcuaaaacaaaacauugagagucc

SEQ ID NO: 2249 - RNA, 137 nt, Homo sapiens
agccagacaagagggucauggggagucacugucaacccagagcaggcacugccccugcgaccagccuggggcaucgguuggggugcaggggucugcuggugaugcuuuccaucucuuugcuuuguccugauuguagc

SEQ ID NO: 2250 - RNA, 58 nt, Homo sapiens
uaugguacuccuuaagcuaacaggccccugucaccauuagcuuaaggaguaccagauc

SEQ ID NO: 2251 - RNA, 58 nt, Homo sapiens
ugcuggcucauuucauaugugugcugagaaaauucacacauaugaagugagccagcac

SEQ ID NO: 2252 - RNA, 60 nt, Homo sapiens
agccuuccaggagaaauggagacccuauacauaccuguuuccaugccuccuagaaguucc

SEQ ID NO: 2253 - RNA, 68 nt, Homo sapiens
uaggcacacuuaaaguuauagcuacaucaguuauaacuauaucaguuaaaacuuuaagugugccuagg

SEQ ID NO: 2254 - RNA, 59 nt, Homo sapiens
aaacuaauauacccauauucuggcuaggugaucaucagaauauggguauauuaguuugg

SEQ ID NO: 2255 - RNA, 59 nt, Homo sapiens
aaacuaauauacccauauucugaugaucaccuagccagaauauggguauauuaguuugg

SEQ ID NO: 2256 - RNA, 60 nt, Homo sapiens
cagggaaaugggaagaacuagauuugaauccagaccuuuaguucuucccuuugcccaauu

SEQ ID NO: 2257 - RNA, 59 nt, Homo sapiens
ugaaguaccagcuacucgagaggucagaggauugcuccugaauagcugggacuacaggu

SEQ ID NO: 2258 - RNA, 59 nt, Homo sapiens
uauccagcuuguuacuauaugcuuuuuaaauggggcacagagugacaagcugguuaaag

SEQ ID NO: 2259 - RNA, 53 nt, Homo sapiens
auggucaccuccgggacucagcccugugcugagccccgggcagugugaucauc

SEQ ID NO: 2260 - RNA, 63 nt, Homo sapiens
acuggcauuagugggacuuuuuuuuuuuuuuuuuuuaauguuaaaagucccacuaaugccagc

SEQ ID NO: 2261 - RNA, 60 nt, Homo sapiens
ggcugggugcucuugugcagugagcaaccuacacaacugcacauggcaaccuagcuccca

SEQ ID NO: 2262 - RNA, 54 nt, Homo sapiens
uugccauacauagacuuuauuguguugaucaacaauaaaguucauguauggcaa

SEQ ID NO: 2263 - RNA, 65 nt, Homo sapiens
ugggagcuaagcuauggguauacugagcuuauguaugcaucugcauacccauagcuuagcuccca

SEQ ID NO: 2264 - RNA, 84 nt, Homo sapiens
gcauuggguuagcagguuagcccagcauuucccuuccuggacacacaggaggagaaaugcuggacuaaucugcuaauccaaugc

SEQ ID NO: 2265 - RNA, 75 nt, Homo sapiens
aguuuuugaagaguauugccacccuuucuagucccuauuagacuagaaaggguggcaauaccucuuccaaaaacu

SEQ ID NO: 2266 - RNA, 60 nt, Homo sapiens
gaagagguauugccacccuuucuagucuaauagggacuagaaaggguggcaauacucuuc

SEQ ID NO: 2267 - RNA, 76 nt, Homo sapiens
ggcccaugggucuuauccugcaaggugcugcagagacgaggccuguagcaccuugcaggauaaggucuacugggcc

SEQ ID NO: 2268 - RNA, 76 nt, Homo sapiens
ggagcuuguuacagaugcagauucucugacuucuuacugcaccagugaagucaggaucugcauuugaauaagaccc

SEQ ID NO: 2269 - RNA, 65 nt, Homo sapiens
gcugaacucuagccugagcaacagagugagauggucuuguuuuguugcccaggcuggaguccagu

SEQ ID NO: 2270 - RNA, 79 nt, Homo sapiens
cucuacaucacagcccagcaguuaucacgggccccuccccucaaugggcccgugauaacugcagggcugugauguagag

SEQ ID NO: 2271 - RNA, 82 nt, Homo sapiens
uaucguaucguaucguaucguauuguauuguacuguauuguauuguacuguauuguaucguaucguaucguaucguaucgua

SEQ ID NO: 2272 - RNA, 77 nt, Homo sapiens
ccucacuuaucugacucugaaaucuucuaaaugguacccacuuuauuuagaacguuuuagggucaaauaaguacagg

SEQ ID NO: 2273 - RNA, 83 nt, Homo sapiens
gaaacacuuugccuuuuuacaggaguuuauuauguuuuggacauagaaacauaacaaacaccuguaaaacagcaaaguguuuc

SEQ ID NO: 2274 - RNA, 78 nt, Homo sapiens
agcgugguagcauacaccuguaguccuagauacucaggagggugaguaucuaggacuacaggugugugcuaccacgcu

SEQ ID NO: 2275 - RNA, 73 nt, Homo sapiens
cuuuuaauuucagcuacuaccucuauuaggauuugggaguuauacuaauagagguaauaguugaaauuaagag

SEQ ID NO: 2276 - RNA, 68 nt, Homo sapiens
ggacaagcuugcucugagcuccgagaaagcugacagacagcugcuugguguucagagcuugucugucc

SEQ ID NO: 2277 - RNA, 69 nt, Homo sapiens
gacaguacaaauaauaccacaguggguguaccucauguguguacacccugugauauuauuuguaauauc

SEQ ID NO: 2278 - RNA, 59 nt, Homo sapiens
uacaaauaauaccacaguggguguaccucauguguguacacccugugauauuauuugua

SEQ ID NO: 2279 - RNA, 87 nt, Homo sapiens
gauauuaugaauaauaucacaguagguguucacacauaauguguacaccauguguguacacccaugugauauuugaaguaguauguc

SEQ ID NO: 2280 - RNA, 91 nt, Homo sapiens
uauaacauuguauauacccacugugauauuaagaguaauagcucucuagguuauuaugaauaauaucacaguagguguacacaauguugua

SEQ ID NO: 2281 - RNA, 77 nt, Homo sapiens
uguguacaccaacugugauauuaggaguccuauuuauuuuuaggauauuaggaauaauaucacaguagguguacaca

SEQ ID NO: 2282 - RNA, 73 nt, Homo sapiens
cugggaaguuaguucauuucagucugugcugugagcuagccagcaguggcucugaaaugaacucaaacucuag

SEQ ID NO: 2283 - RNA, 76 nt, Homo sapiens
gccaacugcagaucaugggacugucucagccccauauguaucugaaggcugagaagucccaugauccgcacuuggc

SEQ ID NO: 2284 - RNA, 85 nt, Homo sapiens
caaggccuaucuaucuagauucuucuuggccucucugagcaugcauuccugagacuccaagaagaaucuagacagauaggccuug

SEQ ID NO: 2285 - RNA, 85 nt, Homo sapiens
gugcucauuuaaguagucugaugccuacuacugaugacauacaauguaagugcucauuuaggcgucagacuaccuaaaugagcac

SEQ ID NO: 2286 - RNA, 78 nt, Homo sapiens
agcauauucucaaguaguuucaugauaaaggguguaugagagaucaacccuuuaucaugaaacgcuugaggauacgcu

SEQ ID NO: 2287 - RNA, 72 nt, Homo sapiens
cugugcaccugggggagugcagugauuguggaaugcaaagucccacaaucacuguacuccccaggugcacag

SEQ ID NO: 2288 - RNA, 90 nt, Homo sapiens
cuguaccccugccccaacaaggaaggacaagaggugugagccacacacacgccuggccuccugucuuuccuuguuggagcagggauguag

SEQ ID NO: 2289 - RNA, 71 nt, Homo sapiens
uuaauuaaugcauuaaauuauugaaggcccuugggcaccccaggccuucaauaauuuaaugcauuuauuga

SEQ ID NO: 2290 - RNA, 82 nt, Homo sapiens
gauuggacuuuauugucacguucugauugguuagccuaagacuuguucugauccaaucagaacaugaaaauaacguccaauc

SEQ ID NO: 2291 - RNA, 82 nt, Homo sapiens; identical to SEQ ID NO: 2290

SEQ ID NO: 2292 - RNA, 84 nt, Homo sapiens
gccucaacuccugggauauguugcugauccaaccugaaauccuucuguagguugagucagcaacauaucccaugacuuuugggu

SEQ ID NO: 2293 - RNA, 56 nt, Homo sapiens
uugccguccccuuccucgucuuuuccccucaggagaagucgggaagguggcggcgg

SEQ ID NO: 2294 - RNA, 77 nt, Homo sapiens
ugaucuuguuuaggccaucaucccauuaugcuaaguccaugggcaaacauaacaggaugauggccuaaacaagacca

SEQ ID NO: 2295 - RNA, 89 nt, Homo sapiens
uccccauuuacacaggccaugagccccgaaacacccaucccaggauugcugauggguguuucggggcucauggccuguguaaaugggga

SEQ ID NO: 2296 - RNA, 80 nt, Homo sapiens
agcuaggucuucuggauaacaugcugaagcuucuacgucauucagcacuugcuucagcauguuuuccagaggaucuagcu

SEQ ID NO: 2297 - RNA, 81 nt, Homo sapiens
uguaagaacacguuugaaugcuguacaaggcacauaugugaacauuguaccacauguacagcuuucaaacaugcucuuaua

SEQ ID NO: 2298 - RNA, 85 nt, Homo sapiens
auuacagacaugagcgacugugccugaccaaaagucaacauuaaacaacaaaucuuggccaggcacaguggcucaugccuguaau

SEQ ID NO: 2299 - RNA, 13 nt, Artificial Sequence
  Description of Artificial Sequence: Synthetic oligonucleotide
gccagguaaguau

SEQ ID NO: 2300 - RNA, 12 nt, Artificial Sequence
  Description of Artificial Sequence: Synthetic oligonucleotide
ccagguaaguau

SEQ ID NO: 2301 - RNA, 11 nt, Artificial Sequence
  Description of Artificial Sequence: Synthetic oligonucleotide
cagguaaguau

SEQ ID NO: 2302 - RNA, 9 nt, Artificial Sequence
  Description of Artificial Sequence: Synthetic oligonucleotide
cagguaagu

SEQ ID NO: 2303 - RNA, 8 nt, Artificial Sequence
  Description of Artificial Sequence: Synthetic oligonucleotide
cagguaag

SEQ ID NO: 2304 - RNA, 7 nt, Artificial Sequence
  Description of Artificial Sequence: Synthetic oligonucleotide
cagguaa

SEQ ID NO: 2305 - RNA, 10 nt, Artificial Sequence
  Description of Artificial Sequence: Synthetic oligonucleotide
cagguaagua

SEQ ID NO: 2306 - DNA, 8 bp, Artificial Sequence
  Description of Artificial Sequence: Synthetic oligonucleotide
tcatcgat

SEQ ID NO: 2307 - DNA, 8 bp, Artificial Sequence
  Description of Artificial Sequence: Synthetic oligonucleotide
aacgttct

SEQ ID NO: 2308 - DNA, 20 bp, Artificial Sequence
  Description of Artificial Sequence: Synthetic oligonucleotide
atcgactctcgagccttctc

The invention claimed is:

1. A chirally controlled oligonucleotide composition comprising a plurality of oligonucleotides of at least one type, wherein each type is defined by:
   1) base sequence;
   2) pattern of backbone linkages;
   3) pattern of backbone chiral centers; and
   4) pattern of backbone X-moieties (—X-L-R$^1$);
   wherein:
   the oligonucleotides of the at least one type comprise one or more phosphorothioate triester internucleotidic linkages and one or more phosphate diester linkage;
   the oligonucleotides of the at least one type comprise at least two consecutive modified internucleotidic linkages; and
   oligonucleotides of the at least one oligonucleotide type comprise one or more modified internucleotidic linkages independently having the structure of formula (I):

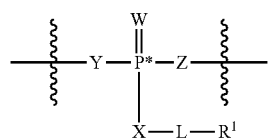

(I)

wherein:
P* is an asymmetric phosphorus atom and is either Rp or Sp;
W is O, S or Se;
each of X, Y and Z is independently —O—, —S—, —N(-L-R$^1$)—, or L;
L is a covalent bond or an optionally substituted, linear or branched C$_1$-C$_{50}$ alkylene, wherein one or more methylene units of L are optionally and independently replaced by an optionally substituted C$_1$-C$_6$ alkylene, C$_1$-C$_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—;

R$^1$ is halogen, R, or an optionally substituted C$_1$-C$_{10}$ aliphatic wherein one or more methylene units are optionally and independently replaced by an optionally substituted C$_1$-C$_6$ alkylene, C$_1$-C$_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—;
each R' is independently —R, —C(O)R, —CO$_2$R, or —SO$_2$R, or:
   two R' on the same nitrogen are taken together with their intervening atoms to form an optionally substituted heterocyclic or heteroaryl ring, or
   two R' on the same carbon are taken together with their intervening atoms to form an optionally substituted aryl, carbocyclic, heterocyclic, or heteroaryl ring;
-Cy- is an optionally substituted bivalent ring selected from phenylene, carbocyclylene, arylene, heteroarylene, or heterocyclylene;
each R is independently hydrogen, or an optionally substituted group selected from C$_1$-C$_6$ aliphatic, phenyl, carbocyclyl, aryl, heteroaryl, or heterocyclyl; and
each

independently represents a connection to a nucleoside.

2. The composition of claim 1, wherein the oligonucleotides are cleaved from a solid support.

3. The composition of claim 2, wherein the oligonucleotides comprise one or more modified internucleotide linkages independently having the structure of formula I-b:

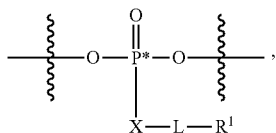
(I-b)

wherein:
P* is an asymmetric phosphorus atom and is either Rp or Sp;
X is —S—;
L is a covalent bond or an optionally substituted, linear or branched $C_1$-$C_{50}$ alkylene, wherein one or more methylene units of L are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—;
$R^1$ is halogen, R, or an optionally substituted $C_1$-$C_{10}$ aliphatic wherein one or more methylene units are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—;
each R' is independently —R, —C(O)R, —CO$_2$R, or —SO$_2$R, or:
  two R' on the same nitrogen are taken together with their intervening atoms to form an optionally substituted heterocyclic or heteroaryl ring, or
  two R' on the same carbon are taken together with their intervening atoms to form an optionally substituted aryl, carbocyclic, heterocyclic, or heteroaryl ring;
-Cy- is an optionally substituted bivalent ring selected from phenylene, carbocyclylene, arylene, heteroarylene, or heterocyclylene;
each R is independently hydrogen, or an optionally substituted group selected from $C_1$-$C_6$ aliphatic, phenyl, carbocyclyl, aryl, heteroaryl, or heterocyclyl; and
each

independently represents a connection to a nucleoside.

4. The composition of claim 3, wherein the oligonucleotides are at least 15 nucleotide units in length.

5. The composition of claim 3, wherein the composition contains predetermined levels of at least two oligonucleotide types.

6. A chirally controlled oligonucleotide comprising one or more modified internucleotide linkages independently having the structure of formula I:

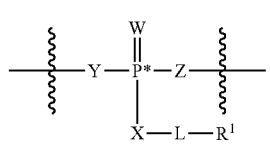
(I)

wherein:
P* is an asymmetric phosphorus atom and is either Rp or Sp;
W is O, S or Se;
each of X, Y and Z is independently —O—, —S—, —N(-L-$R^1$)—, or L;
L is a covalent bond or an optionally substituted, linear or branched $C_1$-$C_{50}$ alkylene, wherein one or more methylene units of L are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—;
$R^1$ is halogen, R, or an optionally substituted $C_1$-$C_{10}$ aliphatic wherein one or more methylene units are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—;
each R' is independently —R, —C(O)R, —CO$_2$R, or —SO$_2$R, or:
  two R' on the same nitrogen are taken together with their intervening atoms to form an optionally substituted heterocyclic or heteroaryl ring, or
  two R' on the same carbon are taken together with their intervening atoms to form an optionally substituted aryl, carbocyclic, heterocyclic, or heteroaryl ring;
-Cy- is an optionally substituted bivalent ring selected from phenylene, carbocyclylene, arylene, heteroarylene, or heterocyclylene;
each R is independently hydrogen, or an optionally substituted group selected from $C_1$-$C_6$ aliphatic, phenyl, carbocyclyl, aryl, heteroaryl, or heterocyclyl; and
each

independently represents a connection to a nucleoside;
  the oligonucleotide comprises one or more phosphorothioate triester internucleotidic linkages and one or more phosphate diester linkage; and
  the oligonucleotide comprises at least two consecutive modified internucleotidic linkages.

7. The chirally controlled oligonucleotide of claim 6, comprising at least 5, at least 6, or at least 7 consecutive modified internucleotidic linkages, and at least one of the consecutive modified internucleotidic linkages is not a phosphorothioate diester linkage.

8. The chirally controlled oligonucleotide of claim 7, wherein the chirally controlled oligonucleotide is at least 15 nucleotide units in length.

9. A pharmaceutical composition comprising a therapeutically effective amount of a composition of claim 1 and a pharmaceutically acceptable excipient.

10. The composition of claim 4, wherein the oligonucleotides comprise one or more modified internucleotide linkages independently having the structure of formula I-b wherein -L-$R^1$ is not hydrogen.

11. The composition of claim 3, wherein the oligonucleotides comprise one or more modified nucleobases.

12. The composition of claim 3, wherein the oligonucleotides comprise one or more modified sugars.

13. The composition of claim 4, wherein the oligonucleotides comprise one or more modified sugars.

14. The composition of claim 10, wherein the oligonucleotides comprise one or more modified sugars.

15. The composition of claim 3, wherein the oligonucleotides comprise one or more 2'-modified sugars.

16. The composition of claim 4, wherein the oligonucleotides comprise one or more 2'-modified sugars.

17. The composition of claim 10, wherein the oligonucleotides comprise one or more 2'-modified sugars.

18. The composition of claim 3, wherein the oligonucleotides comprise one or more 2'-F modifications.

19. The composition of claim 4, wherein the oligonucleotides comprise one or more 2'-F modifications.

20. The composition of claim 10, wherein the oligonucleotides comprise one or more 2'-F modifications.

21. The composition of claim 3, wherein the oligonucleotides comprise one or more 2'-OR' modifications, wherein R' is independently optionally substituted $C_1$-$C_6$ aliphatic.

22. The composition of claim 4, wherein the oligonucleotides comprise one or more 2'-OR' modifications, wherein R' is independently optionally substituted $C_1$-$C_6$ aliphatic.

23. The composition of claim 10, wherein the oligonucleotides comprise one or more 2'-OR' modifications, wherein R' is independently optionally substituted $C_1$-$C_6$ aliphatic.

24. The composition of claim 3, wherein the oligonucleotides comprise one or more locked nucleic acid moieties.

25. The composition of claim 4, wherein the oligonucleotides comprise one or more locked nucleic acid moieties.

26. The composition of claim 10, wherein the oligonucleotides comprise one or more locked nucleic acid moieties.

27. The composition of claim 4, wherein the oligonucleotides comprise at least one Rp modified internucleotidic linkage and at least one Sp modified internucleotidic linkage.

28. The composition of claim 27, wherein the oligonucleotides comprise at least one phosphorothioate diester linkage.

29. The composition of claim 28, wherein the oligonucleotides comprise one or more modified nucleobases.

30. The composition of claim 28, wherein the oligonucleotides comprise one or more modified sugars.

31. The composition of claim 28, wherein the oligonucleotides comprise one or more 2'-modified sugars.

32. The composition of claim 28, wherein the oligonucleotides comprise one or more 2'-F modifications.

33. The composition of claim 28, wherein the oligonucleotides comprise one or more 2'-OR' modifications, wherein R' is independently optionally substituted $C_1$-$C_6$ aliphatic.

34. The composition of claim 28, wherein the oligonucleotides comprise one or more locked nucleic acid moieties.

35. The composition of claim 1, wherein oligonucleotides of at least one oligonucleotide type comprise at least two individual internucleotidic linkages having different P-modifications relative to one another.

36. The composition of claim 35, wherein the oligonucleotides are cleaved from a solid support.

37. The composition of claim 36, wherein the oligonucleotides comprise one or more modified nucleobases.

38. The composition of claim 36, wherein the oligonucleotides comprise one or more modified sugars.

39. The composition of claim 36, wherein the oligonucleotides comprise one or more 2'-modified sugars.

40. The composition of claim 36, wherein the oligonucleotides comprise one or more 2'-F modifications.

41. The composition of claim 36, wherein the oligonucleotides comprise one or more 2'-OR' modifications, wherein R' is independently optionally substituted $C_1$-$C_6$ aliphatic.

42. The composition of claim 36, wherein the oligonucleotides comprise one or more locked nucleic acid moieties.

43. A chirally controlled oligonucleotide composition comprising a plurality of oligonucleotides of the same type, wherein the type is defined by:
1) base sequence;
2) pattern of backbone linkages;
3) pattern of backbone chiral centers; and
4) pattern of backbone X-moieties (—X-L-$R^1$);
wherein:
the oligonucleotides of the same type comprise one or more phosphorothioate triester internucleotidic linkages and one or more phosphate diester linkage;
the oligonucleotides of the same type comprise at least two consecutive modified internucleotidic linkages; and
oligonucleotides of the same type comprise one or more modified internucleotidic linkages independently having the structure of formula (I):

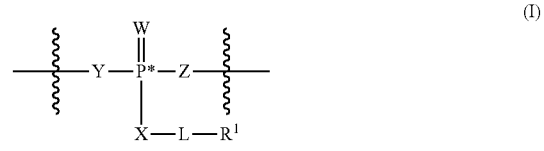

wherein:
P* is an asymmetric phosphorus atom and is either Rp or Sp;
W is O, S or Se;
each of X, Y and Z is independently —O—, —S—, —N(-L-$R^1$)—, or L;
L is a covalent bond or an optionally substituted, linear or branched $C_1$-$C_{50}$ alkylene, wherein one or more methylene units of L are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—;
$R^1$ is halogen, R, or an optionally substituted $C_1$-$C_{10}$ aliphatic wherein one or more methylene units are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—;

each R' is independently —R, —C(O)R, —CO$_2$R, or —SO$_2$R, or:
  two R' on the same nitrogen are taken together with their intervening atoms to form an optionally substituted heterocyclic or heteroaryl ring, or
  two R' on the same carbon are taken together with their intervening atoms to form an optionally substituted aryl, carbocyclic, heterocyclic, or heteroaryl ring;

-Cy- is an optionally substituted bivalent ring selected from phenylene, carbocyclylene, arylene, heteroarylene, or heterocyclylene;

each R is independently hydrogen, or an optionally substituted group selected from $C_1$-$C_6$ aliphatic, phenyl, carbocyclyl, aryl, heteroaryl, or heterocyclyl; and each

independently represents a connection to a nucleoside.

44. The composition of claim 43, wherein the oligonucleotides comprise one or more modified internucleotide linkages independently having the structure of formula I-b:

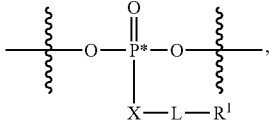
(I-b)

wherein:
P* is an asymmetric phosphorus atom and is either Rp or Sp;
X is —S—;
L is a covalent bond or an optionally substituted, linear or branched $C_1$-$C_{50}$ alkylene, wherein one or more methylene units of L are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—;

$R^1$ is halogen, R, or an optionally substituted $C_1$-$C_{10}$ aliphatic wherein one or more methylene units are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—;

each R' is independently —R, —C(O)R, —CO$_2$R, or —SO$_2$R, or:
  two R' on the same nitrogen are taken together with their intervening atoms to form an optionally substituted heterocyclic or heteroaryl ring, or
  two R' on the same carbon are taken together with their intervening atoms to form an optionally substituted aryl, carbocyclic, heterocyclic, or heteroaryl ring;

-Cy- is an optionally substituted bivalent ring selected from phenylene, carbocyclylene, arylene, heteroarylene, or heterocyclylene;

each R is independently hydrogen, or an optionally substituted group selected from $C_1$-$C_6$ aliphatic, phenyl, carbocyclyl, aryl, heteroaryl, or heterocyclyl; and each

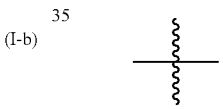

independently represents a connection to a nucleoside.

45. The composition of claim 44, wherein the oligonucleotides are at least 15 nucleotide units in length.

46. The composition of claim 45, wherein the oligonucleotides are cleaved from a solid support.

47. The composition of claim 46, wherein the oligonucleotides comprise-one or more modified nucleobases.

48. The composition of claim 46, wherein the oligonucleotides comprise one or more modified sugars.

* * * * *